US010738130B2

(12) United States Patent
Haber et al.

(10) Patent No.: US 10,738,130 B2
(45) Date of Patent: Aug. 11, 2020

(54) BISPECIFIC ANTIGEN-BINDING MOLECULES THAT BIND MUC16 AND CD3, AND COMPOSITIONS THEREOF

(71) Applicant: Regeneron Pharmaceuticals, Inc., Tarrytown, NY (US)

(72) Inventors: Lauric Haber, Rye Brook, NY (US); Eric Smith, New York, NY (US); Marcus Kelly, New York, NY (US); Jessica R. Kirshner, New York, NY (US); Sandra Coetzee, White Plains, NY (US); Alison Crawford, Dobbs Ferry, NY (US); Thomas Nittoli, Pearl River, NY (US); Yashu Liu, Tarrytown, NY (US)

(73) Assignee: Regeneron Pharmaceuticals, Inc., Tarrytown, NY (US)

(*) Notice: Subject to any disclaimer, the term of this patent is extended or adjusted under 35 U.S.C. 154(b) by 116 days.

(21) Appl. No.: 15/713,574

(22) Filed: Sep. 22, 2017

(65) Prior Publication Data
US 2018/0112001 A1 Apr. 26, 2018

Related U.S. Application Data

(60) Provisional application No. 62/558,711, filed on Sep. 14, 2017, provisional application No. 62/399,249, filed on Sep. 23, 2016.

(51) Int. Cl.
| C07K 16/30 | (2006.01) |
| C07K 16/46 | (2006.01) |
| A61K 39/395 | (2006.01) |
| C07K 16/28 | (2006.01) |
| C07K 16/44 | (2006.01) |
| A61K 47/68 | (2017.01) |
| G01N 33/574 | (2006.01) |
| A61K 39/00 | (2006.01) |

(52) U.S. Cl.
CPC ........ *C07K 16/3092* (2013.01); *A61K 39/395* (2013.01); *A61K 39/39558* (2013.01); *A61K 47/6849* (2017.08); *A61K 47/6851* (2017.08); *A61K 47/6869* (2017.08); *C07K 16/2809* (2013.01); *C07K 16/2863* (2013.01); *C07K 16/3069* (2013.01); *C07K 16/44* (2013.01); *C07K 16/468* (2013.01); *G01N 33/57492* (2013.01); *A61K 2039/505* (2013.01); *C07K 2317/24* (2013.01); *C07K 2317/31* (2013.01); *C07K 2317/33* (2013.01); *C07K 2317/51* (2013.01); *C07K 2317/515* (2013.01); *C07K 2317/56* (2013.01); *C07K 2317/565* (2013.01); *C07K 2317/73* (2013.01); *C07K 2317/92* (2013.01); *C07K 2317/94* (2013.01); *G01N 2333/705* (2013.01)

(58) Field of Classification Search
None
See application file for complete search history.

(56) References Cited

U.S. PATENT DOCUMENTS

| 2014/0088295 A1* | 3/2014 | Smith | C07K 16/2809 |
| | | | 530/387.3 |
| 2017/0320948 A1* | 11/2017 | Smith | C07K 16/2809 |
| 2018/0118848 A1* | 5/2018 | Haber | A61K 47/6869 |

(Continued)

FOREIGN PATENT DOCUMENTS

| WO | 16/149368 A1 | 9/2016 |
| WO | 17/053856 A1 | 3/2017 |

OTHER PUBLICATIONS

Harlow et al. Antibodies, A Laboratory Manual, Chapter 5, p. 76, 1988. (Year: 1988).*

(Continued)

*Primary Examiner* — Peter J Reddig
(74) *Attorney, Agent, or Firm* — Schwabe, Williamson & Wyatt PC; Veronica Mallon

(57) ABSTRACT

Mucin 16 (MUC16) is highly expressed in ovarian cancer and expression on cancer cells is shown to protect tumor cells from the immune system. The present invention provides novel full-length human IgG antibodies that bind to human and MUC16 (monospecific antibodies). The present invention also provides novel bispecific antibodies (bsAbs) that bind to both MUC16 and CD3 and activate T cells via the CD3 complex in the presence of MUC16-expressing tumors. According to certain embodiments, the present invention provides bispecific antigen-binding molecules comprising a first antigen-binding domain that specifically binds human and monkey CD3, and a second antigen-binding molecule that specifically binds human and monkey MUC16. In certain embodiments, the bispecific antigen-binding molecules of the present invention are capable of inhibiting the growth of tumors expressing MUC16. The bispecific antigen-binding molecules of the invention are useful for the treatment of diseases and disorders in which an upregulated or induced MUC16-targeted immune response is desired and/or therapeutically beneficial. For example, the bispecific antibodies of the invention are useful for the treatment of various cancers, including ovarian cancer. The present invention also includes anti-MUC16 antibody drug conjugates which inhibit tumor growth in vivo. In some embodiments, the anti-MUC16 antibodies are useful in diagnostic methods for identifying the presence of MUC16 in tissue and/or plasma samples.

49 Claims, 15 Drawing Sheets
Specification includes a Sequence Listing.

(56) References Cited

U.S. PATENT DOCUMENTS

2018/0355038 A1* 12/2018 Smith ............... C07K 16/2809

OTHER PUBLICATIONS

Marcos-Silva et al. (J. Proteome Research May 21, 2014 13:3349-3359) (Year: 2014).*

Almagro & Fransson, Frontiers in Bioscience 2008; 13:1619-33 (Year: 2008).*

Argueso et al. "MUC16 Mucin is Expressed by the Human Ocular Surface Epithelia and Carries the H185 Carbohydrate Epitope" Invest Ophthalmol Vis Sci., vol. 44 (No. 6):2487-2495 (Jun. 2003).

Berchuck et al. "Immunohistochemical Expression of CA 125 in Endometrial Adenocarcinoma: Correlation of Antigen Expression with Metastatic Potential" Cancer Research, vol. 49(No. 8):2091-2095 (Apr. 15, 1989).

Chen et al. "Armed Antibodies Targeting the Mucin Repeats of the Ovarian Cancer Antigen, MUC16, Are Highly Efficacious in Animal Tumor Models" Cancer Research 2007, vol. 67: (No. 10) (May 15, 2007).

Chetty et al. "CD3: Structure, Function, and Role of Immunostaining in Clinical Practice" Journal of Pathology, vol. 173(No. 4):303-307 (1994).

Das et al. "Membrane proximal ectodomain cleavage of MUC16 occurs in the acidifying Golgi/post-Golgi compartments" Scientific Reports, vol. 5 : 9759; 11 pages (2015); DOI: 10.1038/srep09759.

Das et al. "Understanding the Unique Attributes of MUC16 (CA125): Potential Implications in Targeted Therapy" Cancer Research, vol. 75(No. 22) (Nov. 15, 2015).

Felder et al., "MUC16 (CA125): tumor biomarker to cancer therapy, a work in progress," Molecular Cancer, vol. 13 (No. 129) 15 pages (2014).

Garg et al. Poster CT092, Pharmacokinetics of a THIOMAB™ Antibody Drug Conjugate: DMUC4064A in a Phase I Study with Platinum-Resistant Ovarian Cancer. AACR Annual Meeting 2017; Apr. 1-5, 2017; Washington, DC.

Kabawat et al. "Immunopathologic Characterization of a Monoclonal Antibody that Recognizes Common Surface Antigens of Human Ovarian Tumors of Serous, Endometrioid, and Clear Cell Types" Am J Clin Pathol, vol. 79:98-104 (1983).

Kabawat et al. "Tissue Distribution of a Coelomic-Epithelium-Related Antigen Recognized by the Monoclonal Antibody OC125" International Journal of Gynecological Pathology, vol. 2(No. 3):275-285 (1983).

Matsuoka et al. "Normal Bronchial Mucus Contains High Levels of Cancer-Associated Antigens, CA125, CA19-9, and Carcinoembryonic Antigen" Cancer, vol. 65(No. 3):506-510 (Feb. 1, 1990).

Nouwen et al. "Immunohistochemical Localization of Placental Alkaline Phosphatase, Carcinoembryonic Antigen, and Cancer Antigen 125 in Normal and Neoplastic Human Lung" Cancer Research, vol. 46 (No. 2):866-876 (Feb. 1986).

O'Brien et al., "The CA 125 Gene: A Newly Discovered Extension of the Glycosylated N-Terminal Doain Doubles the Size of This Extracellular Superstructure," Tumor Biology, vol. 23:154-169, (2002).

O'Brien et al., "The CA 125 Gene: An Extracellular Superstructure Dominated by Repeat Sequences," Tumor Biology, vol. 22:348-366, (2001).

Pastuskovas et al., "Effect of Immune Complex Formation on the Distribution of a Novel Antibody to the Ovarian Tumor Antigen CA125," Drug Metabolism and Disposition, vol. 38 (No. 12):2309-2319, (2010).

WIPO Application No. PCT/US2017/053113, PCT International Preliminary Report on Patentability dated Mar. 26, 2019.

WIPO Application No. PCT/US2017/053114, PCT International Preliminary Report on Patentability dated Mar. 26, 2019.

WIPO Application No. PCT/US2017/053113, PCT Invitation to Pay Additional fees and, Where Applicable, Protect Fee dated Nov. 28, 2017.

WIPO Application No. PCT/US2017/053114, PCT International Search Report and Written Opinion of the International Searching Authority dated Dec. 1, 2017.

WIPO Application No. PCT/US2017/053113, PCT International Search Report dated Jan. 26, 2018.

* cited by examiner

BISPECIFIC ANTIGEN-BINDING MOLECULES THAT BIND MUC16 AND CD3, AND COMPOSITIONS THEREOF

CROSS-REFERENCE TO RELATED APPLICATIONS

This Application claims the benefit under 35 USC § 119(e) of U.S. Provisional Patent Application No. 62/399,249, filed Sep. 23, 2016, and U.S. Provisional Patent Application No. 62/558,711, filed Sep. 14, 2017.

REFERENCE TO A SEQUENCE LISTING

This application incorporates by reference the Sequence Listing submitted in Computer Readable Form as file 10295US01-Sequence.txt, created on Sep. 22, 2017 and containing 893,983 bytes.

FIELD OF THE INVENTION

The present invention relates to antibodies, and antigen-binding fragments thereof, which are specific for Mucin 16 (MUC16), and methods of use thereof. The present invention also relates to bispecific antigen-binding molecules that bind MUC16 and CD3, and methods of use thereof. The present invention further relates to antibody-drug conjugates comprising an anti-MUC16 antibody or fragment thereof and a therapeutic agent (e.g., a cytotoxic agent).

BACKGROUND

Mucin 16 (MUC16), also known as cancer antigen 125, carcinoma antigen 125, carbohydrate antigen 125, or CA-125, is a single transmembrane domain highly glycosylated integral membrane glycoprotein that is highly expressed in ovarian cancer. MUC16 consists of three major domains: an extracellular N-terminal domain, a large tandem repeat domain interspersed with sea urchin sperm, enterokinase, and agrin (SEA) domains, and a carboxyl terminal domain that comprises a segment of the transmembrane region and a short cytoplasmic tail. Proteolytic cleavage results in shedding of much of the extracellular portion of MUC16 into the bloodstream. MUC16 is overexpressed in cancers including ovarian cancer, breast cancer, pancreatic cancer, non-small-cell lung cancer, intrahepatic cholangiocarcinoma-mass forming type, adenocarcinoma of the uterine cervix, and adenocarcinoma of the gastric tract, and in diseases and conditions including inflammatory bowel disease, liver cirrhosis, cardiac failure, peritoneal infection, and abdominal surgery. (Haridas, D. et al., 2014, FASEB J., 28:4183-4199). Expression on cancer cells is shown to protect tumor cells from the immune system. (Felder, M. et al., 2014, Molecular Cancer, 13:129) Methods for treating ovarian cancer using antibodies to MUC16 have been investigated. Oregovomab and abgovomab are anti-MUC16 antibodies which have had limited success. (Felder, supra, Das, S. and Batra, S. K. 2015, Cancer Res. 75:4660-4674.)

CD3 is a homodimeric or heterodimeric antigen expressed on T cells in association with the T cell receptor complex (TCR) and is required for T cell activation. Functional CD3 is formed from the dimeric association of two of four different chains: epsilon, zeta, delta and gamma. The CD3 dimeric arrangements include gamma/epsilon, delta/epsilon and zeta/zeta. Antibodies against CD3 have been shown to cluster CD3 on T cells, thereby causing T cell activation in a manner similar to the engagement of the TCR by peptide-loaded MHC molecules. Thus, anti-CD3 antibodies have been proposed for therapeutic purposes involving the activation of T cells. In addition, bispecific antibodies that are capable of binding CD3 and a target antigen have been proposed for therapeutic uses involving targeting T cell immune responses to tissues and cells expressing the target antigen.

Antigen-binding molecules that target MUC16, including antibody-drug conjugates, as well as bispecific antigen-binding molecules that bind both MUC16 and CD3 would be useful in therapeutic settings in which specific targeting and T cell-mediated killing of cells that express MUC16 is desired.

BRIEF SUMMARY OF THE INVENTION

In a first aspect, the present invention provides antibodies and antigen-binding fragments thereof that bind to human MUC16. The antibodies according to this aspect of the invention are useful, inter alia, for targeting cells expressing MUC16. The present invention also provides bispecific antibodies and antigen-binding fragments thereof that bind human MUC16 and human CD3. The bispecific antibodies according to this aspect of the invention are useful, inter alia, for targeting T cells expressing CD3, and for stimulating T cell activation, e.g., under circumstances where T cell-mediated killing of cells expressing MUC16 is beneficial or desirable. For example, the bispecific antibodies can direct CD3-mediated T cell activation to specific MUC16-expressing cells, such as ovarian tumor cells.

Exemplary anti-MUC16 antibodies of the present invention are listed in Tables 1 and 2 herein. Table 1 sets forth the amino acid sequence identifiers of the heavy chain variable regions (HCVRs) and light chain variable regions (LCVRs), as well as heavy chain complementarity determining regions (HCDR1, HCDR2 and HCDR3), and light chain complementarity determining regions (LCDR1, LCDR2 and LCDR3) of the exemplary anti-MUC16 antibodies. Table 2 sets forth the sequence identifiers of the nucleic acid molecules encoding the HCVRs, LCVRs, HCDR1, HCDR2 HCDR3, LCDR1, LCDR2 and LCDR3 of the exemplary anti-MUC16 antibodies.

The present invention provides antibodies, or antigen-binding fragments thereof, comprising an HCVR comprising an amino acid sequence selected from any of the HCVR amino acid sequences listed in Table 1, or a substantially similar sequence thereof having at least 90%, at least 95%, at least 98% or at least 99% sequence identity thereto.

The present invention also provides antibodies, or antigen-binding fragments thereof, comprising an LCVR comprising an amino acid sequence selected from any of the LCVR amino acid sequences listed in Table 1, or a substantially similar sequence thereof having at least 90%, at least 95%, at least 98% or at least 99% sequence identity thereto.

The present invention also provides antibodies, or antigen-binding fragments thereof, comprising an HCVR and an LCVR amino acid sequence pair (HCVR/LCVR) comprising any of the HCVR amino acid sequences listed in Table 1 paired with any of the LCVR amino acid sequences listed in Table 1. According to certain embodiments, the present invention provides antibodies, or antigen-binding fragments thereof, comprising an HCVR/LCVR amino acid sequence pair contained within any of the exemplary anti-MUC16 antibodies listed in Table 1. In certain embodiments, the HCVR/LCVR amino acid sequence pair is of SEQ ID NOs: 18/26 (e.g., H1H8767P).

The present invention also provides antibodies, or antigen-binding fragments thereof, comprising a heavy chain CDR1 (HCDR1) comprising an amino acid sequence selected from any of the HCDR1 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a heavy chain CDR2 (HCDR2) comprising an amino acid sequence selected from any of the HCDR2 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a heavy chain CDR3 (HCDR3) comprising an amino acid sequence selected from any of the HCDR3 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a light chain CDR1 (LCDR1) comprising an amino acid sequence selected from any of the LCDR1 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a light chain CDR2 (LCDR2) comprising an amino acid sequence selected from any of the LCDR2 amino acid sequences listed in Table 1 or a substantially similar sequence thereof having at least 90%, at least 95%, at least 98% or at least 99% sequence identity.

The present invention also provides antibodies, or antigen-binding fragments thereof, comprising a light chain CDR3 (LCDR3) comprising an amino acid sequence selected from any of the LCDR3 amino acid sequences listed in Table 1 or a substantially similar sequence thereof having at least 90%, at least 95%, at least 98% or at least 99% sequence identity.

The present invention also provides antibodies, or antigen-binding fragments thereof, comprising an HCDR3 and an LCDR3 amino acid sequence pair (HCDR3/LCDR3) comprising any of the HCDR3 amino acid sequences listed in Table 1 paired with any of the LCDR3 amino acid sequences listed in Table 1. According to certain embodiments, the present invention provides antibodies, or antigen-binding fragments thereof, comprising an HCDR3/LCDR3 amino acid sequence pair contained within any of the exemplary anti-MUC16 antibodies listed in Table 1. In certain embodiments, the HCDR3/LCDR3 amino acid sequence pair is of SEQ ID NOs: 24/32 (e.g., H1H8767P).

The present invention also provides antibodies, or antigen-binding fragments thereof, comprising a set of six CDRs (i.e., HCDR1-HCDR2-HCDR3-LCDR1-LCDR2-LCDR3) contained within any of the exemplary anti-MUC16 antibodies listed in Table 1. In certain embodiments, the HCDR1-HCDR2-HCDR3-LCDR1-LCDR2-LCDR3 amino acid sequences set is selected from the group consisting of SEQ ID NOs: 20-22-24-28-30-32 (e.g., H1H8767P).

In a related embodiment, the present invention provides antibodies, or antigen-binding fragments thereof, comprising a set of six CDRs (i.e., HCDR1-HCDR2-HCDR3-LCDR1-LCDR2-LCDR3) contained within an HCVR/LCVR amino acid sequence pair as defined by any of the exemplary anti-MUC16 antibodies listed in Table 1. For example, the present invention includes antibodies, or antigen-binding fragments thereof, comprising the HCDR1-HCDR2-HCDR3-LCDR1-LCDR2-LCDR3 amino acid sequences set contained within an HCVR/LCVR amino acid sequence pair of SEQ ID NOs: 18/26 (e.g., H1H8767P). Methods and techniques for identifying CDRs within HCVR and LCVR amino acid sequences are well known in the art and can be used to identify CDRs within the specified HCVR and/or LCVR amino acid sequences disclosed herein. Exemplary conventions that can be used to identify the boundaries of CDRs include, e.g., the Kabat definition, the Chothia definition, and the AbM definition. In general terms, the Kabat definition is based on sequence variability, the Chothia definition is based on the location of the structural loop regions, and the AbM definition is a compromise between the Kabat and Chothia approaches. See, e.g., Kabat, "Sequences of Proteins of Immunological Interest," National Institutes of Health, Bethesda, Md. (1991); Al-Lazikani et al., *J. Mol. Biol.* 273:927-948 (1997); and Martin et al., *Proc. Natl. Acad. Sci. USA* 86:9268-9272 (1989). Public databases are also available for identifying CDR sequences within an antibody.

The present invention also provides nucleic acid molecules encoding anti-MUC16 antibodies or portions thereof. For example, the present invention provides nucleic acid molecules encoding any of the HCVR amino acid sequences listed in Table 1; in certain embodiments the nucleic acid molecule comprises a polynucleotide sequence selected from any of the HCVR nucleic acid sequences listed in Table 2, or a substantially similar sequence thereof having at least 90%, at least 95%, at least 98% or at least 99% sequence identity thereto.

The present invention also provides nucleic acid molecules encoding any of the LCVR amino acid sequences listed in Table 1; in certain embodiments the nucleic acid molecule comprises a polynucleotide sequence selected from any of the LCVR nucleic acid sequences listed in Table 2, or a substantially similar sequence thereof having at least 90%, at least 95%, at least 98% or at least 99% sequence identity thereto.

The present invention also provides nucleic acid molecules encoding any of the HCDR1 amino acid sequences listed in Table 1; in certain embodiments the nucleic acid molecule comprises a polynucleotide sequence selected from any of the HCDR1 nucleic acid sequences listed in Table 2, or a substantially similar sequence thereof having at least 90%, at least 95%, at least 98% or at least 99% sequence identity thereto.

The present invention also provides nucleic acid molecules encoding any of the HCDR2 amino acid sequences listed in Table 1; in certain embodiments the nucleic acid molecule comprises a polynucleotide sequence selected from any of the HCDR2 nucleic acid sequences listed in Table 2, or a substantially similar sequence thereof having at least 90%, at least 95%, at least 98% or at least 99% sequence identity thereto.

The present invention also provides nucleic acid molecules encoding any of the HCDR3 amino acid sequences listed in Table 1; in certain embodiments the nucleic acid molecule comprises a polynucleotide sequence selected from any of the HCDR3 nucleic acid sequences listed in Table 2, or a substantially similar sequence thereof having at least 90%, at least 95%, at least 98% or at least 99% sequence identity thereto.

The present invention also provides nucleic acid molecules encoding any of the LCDR1 amino acid sequences listed in Table 1; in certain embodiments the nucleic acid molecule comprises a polynucleotide sequence selected from any of the LCDR1 nucleic acid sequences listed in Table 2, or a substantially similar sequence thereof having at least 90%, at least 95%, at least 98% or at least 99% sequence identity thereto.

The present invention also provides nucleic acid molecules encoding any of the LCDR2 amino acid sequences listed in Table 1; in certain embodiments the nucleic acid molecule comprises a polynucleotide sequence selected from any of the LCDR2 nucleic acid sequences listed in Table 2, or a substantially similar sequence thereof having at least 90%, at least 95%, at least 98% or at least 99% sequence identity thereto.

The present invention also provides nucleic acid molecules encoding any of the LCDR3 amino acid sequences listed in Table 1; in certain embodiments the nucleic acid molecule comprises a polynucleotide sequence selected from any of the LCDR3 nucleic acid sequences listed in Table 2, or a substantially similar sequence thereof having at least 90%, at least 95%, at least 98% or at least 99% sequence identity thereto.

The present invention also provides nucleic acid molecules encoding an HCVR, wherein the HCVR comprises a set of three CDRs (i.e., HCDR1-HCDR2-HCDR3), wherein the HCDR1-HCDR2-HCDR3 amino acid sequence set is as defined by any of the exemplary anti-MUC16 antibodies listed in Table 1.

The present invention also provides nucleic acid molecules encoding an LCVR, wherein the LCVR comprises a set of three CDRs (i.e., LCDR1-LCDR2-LCDR3), wherein the LCDR1-LCDR2-LCDR3 amino acid sequence set is as defined by any of the exemplary anti-MUC16 antibodies listed in Table 1.

The present invention also provides nucleic acid molecules encoding both an HCVR and an LCVR, wherein the HCVR comprises an amino acid sequence of any of the HCVR amino acid sequences listed in Table 1, and wherein the LCVR comprises an amino acid sequence of any of the LCVR amino acid sequences listed in Table 1. In certain embodiments, the nucleic acid molecule comprises a polynucleotide sequence selected from any of the HCVR nucleic acid sequences listed in Table 2, or a substantially similar sequence thereof having at least 90%, at least 95%, at least 98% or at least 99% sequence identity thereto, and a polynucleotide sequence selected from any of the LCVR nucleic acid sequences listed in Table 2, or a substantially similar sequence thereof having at least 90%, at least 95%, at least 98% or at least 99% sequence identity thereto. In certain embodiments according to this aspect of the invention, the nucleic acid molecule encodes an HCVR and LCVR, wherein the HCVR and LCVR are both derived from the same anti-MUC16 antibody listed in Table 1.

The present invention also provides recombinant expression vectors capable of expressing a polypeptide comprising a heavy or light chain variable region of an anti-MUC16 antibody. For example, the present invention includes recombinant expression vectors comprising any of the nucleic acid molecules mentioned above, i.e., nucleic acid molecules encoding any of the HCVR, LCVR, and/or CDR sequences as set forth in Table 1. Also included within the scope of the present invention are host cells into which such vectors have been introduced, as well as methods of producing the antibodies or portions thereof by culturing the host cells under conditions permitting production of the antibodies or antibody fragments, and recovering the antibodies and antibody fragments so produced.

The present invention includes anti-MUC16 antibodies having a modified glycosylation pattern. In some embodiments, modification to remove undesirable glycosylation sites may be useful, or an antibody lacking a fucose moiety present on the oligosaccharide chain, for example, to increase antibody dependent cellular cytotoxicity (ADCC) function (see Shield et al. (2002) JBC 277:26733). In other applications, modification of galactosylation can be made in order to modify complement dependent cytotoxicity (CDC).

In another aspect, the invention provides a pharmaceutical composition comprising a recombinant human antibody or fragment thereof which specifically binds MUC16 and a pharmaceutically acceptable carrier. In a related aspect, the invention features a composition which is a combination of an anti-MUC16 antibody and a second therapeutic agent. In one embodiment, the second therapeutic agent is any agent that is advantageously combined with an anti-MUC16 antibody. Additional combination therapies and co-formulations involving the anti-MUC16 antibodies of the present invention are disclosed elsewhere herein.

In another aspect, the invention provides therapeutic methods for targeting/killing tumor cells expressing MUC16 using an anti-MUC16 antibody of the invention, wherein the therapeutic methods comprise administering a therapeutically effective amount of a pharmaceutical composition comprising an anti-MUC16 antibody of the invention to a subject in need thereof. In some cases, the anti-MUC16 antibodies (or antigen-binding fragments thereof) can be used for treating cancer (e.g., ovarian cancer), or may be modified to be more cytotoxic by methods, including but not limited to, modified Fc domains to increase ADCC (see e.g. Shield et al. (2002) JBC 277:26733), radioimmunotherapy, antibody-drug conjugates, or other methods for increasing the efficiency of tumor ablation.

The present invention also includes the use of an anti-MUC16 antibody of the invention in the manufacture of a medicament for the treatment of a disease or disorder (e.g., cancer) related to or caused by MUC16-expressing cells. In one aspect, the invention relates to a compound comprising an anti-MUC16 antibody or antigen-binding fragment, or a MUC16×CD3 bispecific antibody, as disclosed herein, for use in medicine. In one aspect, the invention relates to a compound comprising an antibody-drug conjugate (ADC) as disclosed herein, for use in medicine.

In yet another aspect, the invention provides monospecific anti-MUC16 antibodies for diagnostic applications, such as, e.g., imaging reagents.

In yet another aspect, the invention provides therapeutic methods for stimulating T cell activation using an anti-CD3 antibody or antigen-binding portion of an antibody of the invention, wherein the therapeutic methods comprise administering a therapeutically effective amount of a pharmaceutical composition comprising an antibody In another aspect, the present invention provides an isolated antibody or antigen-binding fragment thereof that binds human mucin 16 (MUC16) with a binding dissociation equilibrium constant ($K_D$) of less than about 53 nM as measured in a surface plasmon resonance assay at 25° C. In yet another aspect, the present invention provides an isolated antibody or antigen-binding fragment thereof that binds human MUC16 with a dissociative half-life (t ½) of greater than about 15 minutes as measured in a surface plasmon resonance assay at 25° C.

The invention further provides an antibody or antigen-binding fragment that competes for binding to human MUC16 with a reference antibody comprising an HCVR/LCVR amino acid sequence pair as set forth in Table 1. In another aspect, the invention provides an antibody or antigen-binding fragment that competes for binding to human MUC16 with a reference antibody comprising an HCVR/LCVR amino acid sequence pair selected from the group consisting of SEQ ID NOs: 2/10; 18/26; 34/42; 50/58, 66/74; 82/90; 98/106; 114/122; 130/138; 146/154; 162/170; 178/186; 194/394; 202/210; 218/226, 234/242; 250/1936; 258/266; 274/1936; 282/290; 298/306; 314/322; 330/338; 346/354; 362/370; and 378/386.

The invention furthermore provides an antibody or antigen-binding fragment, wherein the antibody or antigen-binding fragment thereof binds to the same epitope on human MUC16 as a reference antibody comprising an HCVR/LCVR amino acid sequence pair as set forth in Table 1. In another aspect, the antibody or antigen-binding fragment binds to the same epitope on human MUC16 as a reference antibody comprising an HCVR/LCVR amino acid sequence pair selected from the group consisting of SEQ ID NOs: 2/10; 18/26; 34/42; 50/58, 66/74; 82/90; 98/106; 114/122; 130/138; 146/154; 162/170; 178/186; 194/394; 202/210; 218/226, 234/242; 250/1936; 258/266; 274/1936; 282/290; 298/306; 314/322; 330/338; 346/354; 362/370; and 378/386.

The invention further provides an isolated antibody or antigen-binding fragment thereof that binds human MUC16, wherein the antibody or antigen-binding fragment comprises: the complementarity determining regions (CDRs) of a heavy chain variable region (HCVR) having an amino acid sequence as set forth in Table 1; and the CDRs of a light chain variable region (LCVR) having an amino acid sequence as set forth in Table 1. In another aspect, the isolated antibody or antigen-binding fragment comprises the heavy and light chain CDRs of a HCVR/LCVR amino acid sequence pair selected from the group consisting of: 2/10; 18/26; 34/42; 50/58, 66/74; 82/90; 98/106; 114/122; 130/138; 146/154; 162/170; 178/186; 194/394; 202/210; 218/226, 234/242; 250/1936; 258/266; 274/1936; 282/290; 298/306; 314/322; 330/338; 346/354; 362/370; and 378/386. In yet another aspect, the isolated antibody or antigen-binding fragment comprises HCDR1-HCDR2-HCDR3-LCDR1-LCDR2-LCDR3 domains, respectively, selected from the group consisting of: SEQ ID NOs: 4-6-8-12-14-16; 20-22-24-28-30-32; 36-38-40-44-46-48; 52-54-56-60-62-64; 68-70-72-76-78-80; 84-86-88-92-94-96; 100-102-104-108-110-112; 116-118-120-124-126-128; 132-134-136-140-142-144; 148-150-152-156-158-160; 164-166-168-172-174-176; 180-182-184-188-190-192; 196-198-200-396-398-400; 204-206-208-212-214-216; 220-222-224-228-230-232; 236-238-240-244-246-248; 252-254-256-1938-1940-1942; 260-262-264-268-270-272; 276-278-280-1938-1940-1942; 284-286-288-292-294-296; 300-302-304-308-310-312; 316-318-320-324-326-328; 332-334-336-340-342-344; 348-350-352-356-358-360; 364-366-368-372-374-376; and 380-382-384-388-390-392.

In another aspect, the invention provides an isolated antibody or antigen-binding fragment thereof that binds human MUC16, wherein the antibody or antigen-binding fragment comprises: (a) a heavy chain variable region (HCVR) having an amino acid sequence selected from the group consisting of SEQ ID NOs: 2, 18, 34, 50, 66, 82, 98, 114, 130, 146, 162, 178, 194, 202, 218, 234, 250, 258, 274, 282, 298, 314, 330, 346, 362, and 378; and (b) a light chain variable region (LCVR) having an amino acid sequence selected from the group consisting of SEQ ID NOs: 10; 26; 42; 58, 74; 90; 106; 122; 138; 154; 170; 186; 210; 226; 242; 266; 290; 306; 322; 338; 354; 370; 386; 1936 and 394. In a further aspect, the isolated antibody or antigen-binding fragment of claim 10, wherein the antibody or antigen-binding fragment comprises a HCVR/LCVR amino acid sequence pair selected from the group consisting of: SEQ ID NOs: 2/10; 18/26; 34/42; 50/58, 66/74; 82/90; 98/106; 114/122; 130/138; 146/154; 162/170; 178/186; 194/394; 202/210; 218/226, 234/242; 250/1936; 258/266; 274/1936; 282/290; 298/306; 314/322; 330/338; 346/354; 362/370; and 378/386.

The invention further provides an isolated antibody or antigen-binding fragment thereof that binds human MUC16 within an epitope ranging from residue 428 to residue 481 of SEQ ID NO: 1902. In some cases, the isolated antibody or antigen-binding fragment interacts with amino acid residues 428-434, 429-434, 453-467, 459-467, 460-467 and/or 474-481 of SEQ ID NO: 1902. In some embodiments, the antibody or antigen-binding fragment interacts with amino acid residues 428-434, 429-434, 453-467, 459-467, 460-467 and 474-481 of SEQ ID NO: 1902. The invention further provides an isolated antibody or antigen-binding fragment thereof that binds human MUC16 within an epitope ranging from residue 126 to residue 138 of SEQ ID NO: 1902. In some cases, the isolated antibody or antigen-binding fragment interacts with amino acid residues 126-131, 127-131 and/or 132-138 of SEQ ID NO: 1902. In some embodiments, the antibody or antigen-binding fragment interacts with amino acid residues 126-131, 127-131 and 132-138 of SEQ ID NO: 1902. The invention further provides an isolated antibody or antigen-binding fragment thereof that binds human MUC16 within an epitope ranging from residue 357 to residue 369 of SEQ ID NO: 1902. In some cases, the isolated antibody or antigen-binding fragment interacts with amino acid residues 357-369, 358-366, 358-369 and/or 361-369 of SEQ ID NO: 1902. In some embodiments, the antibody or antigen-binding fragment interacts with amino acid residues 357-369, 358-366, 358-369 and 361-369 of SEQ ID NO: 1902. The invention further provides an isolated antibody or antigen-binding fragment thereof that binds human MUC16 within one or more of the five membrane-proximal SEA domains of human MUC 16 (SEQ ID NO: 1899). The five membrane-proximal SEA domains correspond to residues 13791-14451 of SEQ ID NO: 1899. In some cases, the antibody or antigen-binding fragment binds with a $K_D$ of less than about 60 nM as measured in a surface plasmon resonance assay at 25° C. In some embodiments, the antibody or antigen-binding fragment binds within residues 14237 to 14290 of SEQ ID NO: 1899. In one embodiment, the antibody or antigen-binding fragment comprises CDRs of a HCVR/LCVR pair comprising the amino acid sequences of SEQ ID NO: 18/26. In some embodiments, the antibody or antigen-binding fragment binds within residues 13935 to 13947 of SEQ ID NO: 1899. In one embodiment, the antibody or antigen-binding fragment comprises CDRs of a HCVR/LCVR pair comprising the amino acid sequences of SEQ ID NO: 82/858. In some embodiments, the antibody or antigen-binding fragment binds within residues 14165 to 14178 of SEQ ID NO: 1899. In one embodiment, the antibody or antigen-binding fragment comprises CDRs of a HCVR/LCVR pair comprising the amino acid sequences of SEQ ID NO: 98/170.

In one aspect, the invention provides antibodies or antigen-binding fragments thereof that bind to one of more of the SEA domains of MUC16. In various embodiments, the anti-MUC16 antibodies or antigen-binding fragments bind to any one of more of SEA1, SEA2, SEA3, SEA4, SEA5, SEA6, SEA7, SEA8, SEA9, SEA10, SEA11, SEA12, SEA13, SEA14, SEA15 or SEA16. In one embodiment, the anti-MUC16 antibody or fragment binds within SEA1 (residues 12074 to 12229 of SEQ ID NO: 1899). In one embodiment, the anti-MUC16 antibody or fragment binds within SEA2 (residues 12230 to 12387 of SEQ ID NO: 1899). In one embodiment, the anti-MUC16 antibody or fragment binds within SEA3 (residues 12388 to 12543 of SEQ ID NO: 1899). In one embodiment, the anti-MUC16 antibody or fragment binds within SEA4 (residues 12544 to 12698 of SEQ ID NO: 1899). In one embodiment, the anti-MUC16 antibody or fragment binds within SEA5 (residues 12699 to 12854 of SEQ ID NO: 1899). In one embodiment, the anti-MUC16 antibody or fragment binds within SEA6 (residues 12855 to 13010 of SEQ ID NO: 1899). In one embodiment, the anti-MUC16 antibody or fragment binds within SEA7 (residues 13011 to 13166 of SEQ ID NO: 1899). In one embodiment, the anti-MUC16 antibody or fragment binds within SEA8 (residues 13167 to 13323 of SEQ ID NO: 1899). In one embodiment, the anti-MUC16 antibody or fragment binds within SEA9 (residues 13324 to 13478 of SEQ ID NO: 1899). In one embodiment, the anti-MUC16 antibody or fragment binds within SEA10 (residues 13479 to 13634 of SEQ ID NO: 1899). In one embodiment, the anti-MUC16 antibody or fragment binds within SEA11 (residues 13635 to 13790 of SEQ ID NO: 1899). In one embodiment, the anti-MUC16 antibody or fragment binds within SEA12 (residues 13791 to 13923 of SEQ ID NO: 1899). In one embodiment, the anti-MUC16 antibody or fragment binds within SEA13 (residues 13924 to 14074 of SEQ ID NO: 1899). In one embodiment, the anti-MUC16 antibody or fragment binds within SEA14 (residues 14075 to 14227 of SEQ ID NO: 1899). In one embodiment, the anti-MUC16 antibody or fragment binds within SEA15 (residues 14228 to 14320 of SEQ ID NO: 1899). In one embodiment, the anti-MUC16 antibody or fragment binds within SEA16 (residues 14321 to 14464 of SEQ ID NO: 1899).

According to another aspect, the present invention provides antibody-drug conjugates comprising an anti-MUC16 antibody or antigen-binding fragment thereof and a therapeutic agent (e.g., a cytotoxic agent). In some embodiments, the antibody or antigen-binding fragment and the cytotoxic agent are covalently attached via a linker, as discussed herein. In various embodiments, the anti-MUC16 antibody or antigen-binding fragment can be any of the anti-MUC16 antibodies or fragments described herein.

In some embodiments, the cytotoxic agent is selected from an auristatin, a maytansinoid, a tubulysin, a tomaymycin derivative, or a dolastatin derivative. In some cases, the cytotoxic agent is an auristatin selected from MMAE or MMAF, or a maytansinoid selected from DM1 or DM4. In some embodiments, the cytotoxic agent is a maytansinoid having the structure of Formula (I) or Formula (II), as discussed herein.

In some embodiments, the cytotoxic agent is a maytansinoid having the structure:

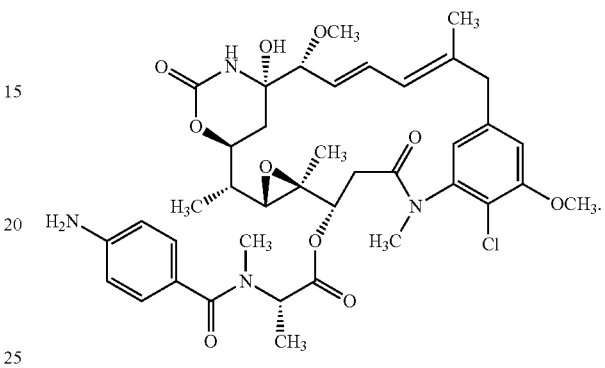

In some embodiments, the cytotoxic agent is a maytansinoid having the structure:

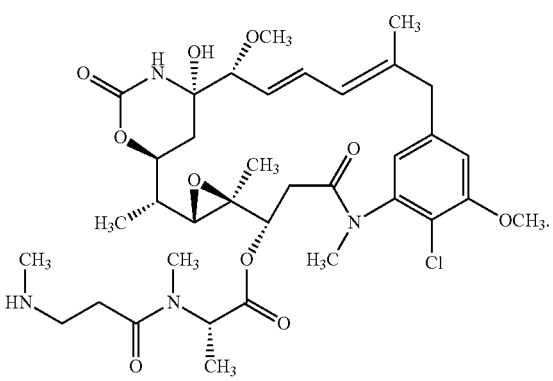 [SMILES: CNCCC(=O)N(C)[C@@H](C)C(=O)O[C@H]1CC(=O)N(C)c2cc(cc(OC)c2Cl)C/C(C)=C/C=C/[C@@H](OC)[C@@]2(O)C[C@H](OC(=O)N2)[C@@H](C)[C@@H]2O[C@@]12C]

In some embodiments, the antibody-drug conjugate comprises an anti-MUC16 antibody or fragment thereof, and

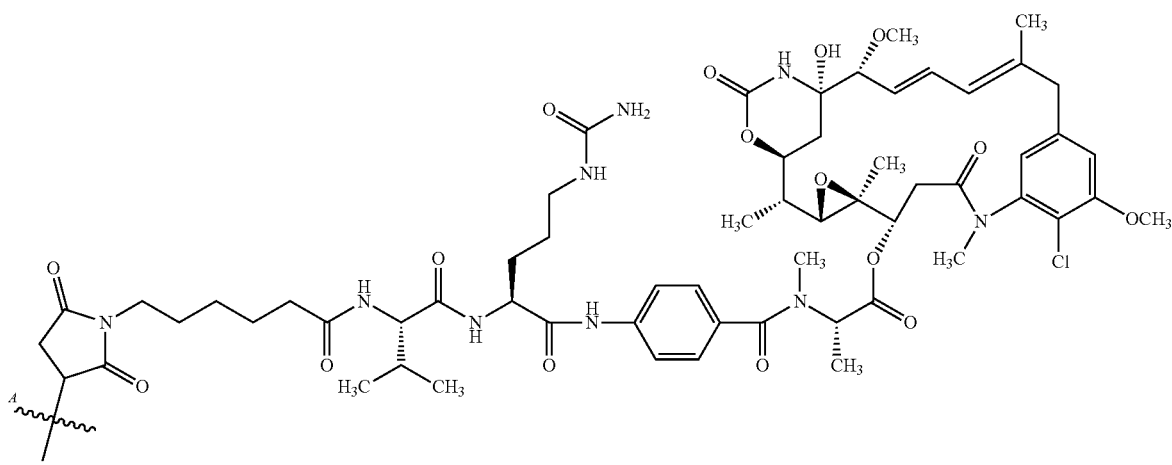

wherein

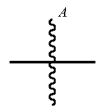

is a bond to the anti-MUC16 antibody or fragment thereof.

In some embodiments, the antibody-drug conjugate comprises an anti-MUC16 antibody or fragment thereof, and

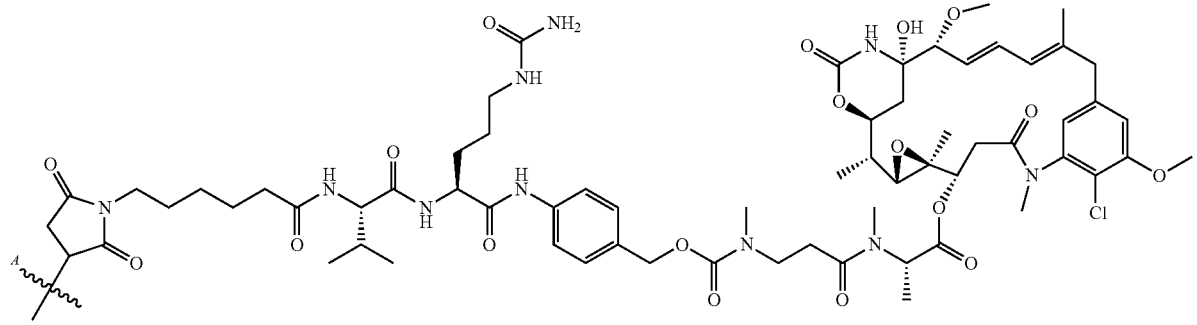

wherein

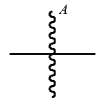

is a bond to the anti-MUC16 antibody or fragment thereof.

In some embodiments, the antibody-drug conjugate comprises an anti-MUC16 antibody or fragment thereof, and

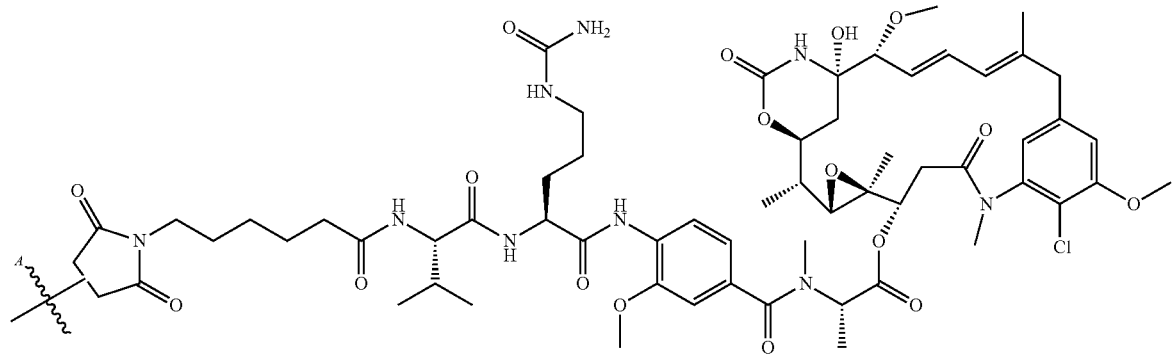

wherein

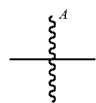

is a bond to the anti-MUC16 antibody or fragment thereof.

In some embodiments, the bond contacts the antibody or fragment thereof via a sulfur constituent of a cysteine residue.

In some embodiments, the antibody-drug conjugate comprises an anti-MUC16 antibody or fragment thereof, and

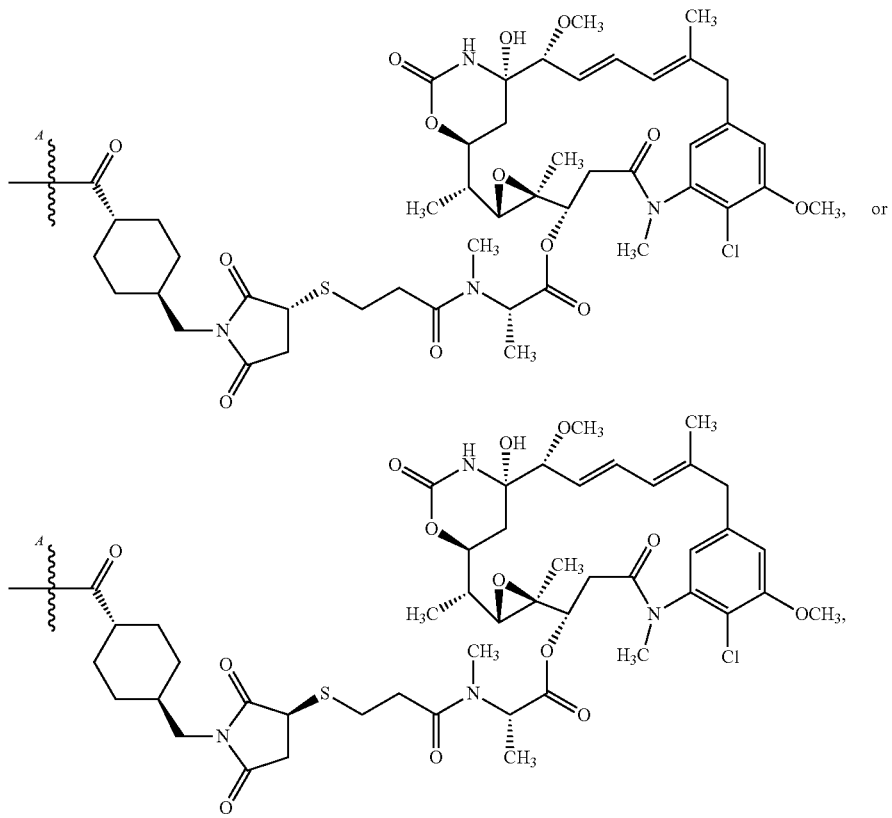

or a mixture thereof,
wherein

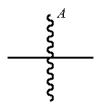

is a bond to the anti-MUC16 antibody or fragment thereof.

In some embodiments, the bond contacts the antibody or fragment thereof via a nitrogen constituent of a lysine residue.

In any of the various embodiments of the antibody-drug conjugates discussed above or herein, the antibody-drug conjugate can comprise from 1 to 4 cytotoxic agents per anti-MUC16 antibody or fragment thereof.

According to another aspect, the present invention provides bispecific antigen-binding molecules (e.g., antibodies) that bind MUC16 and CD3. Such bispecific antigen-binding molecules are also referred to herein as "anti-MUC16/anti-CD3 bispecific molecules," "anti-CD3/anti-MUC16 bispecific molecules," or "MUC16×CD3 bsAbs." The anti-MUC16 portion of the anti-MUC16/anti-CD3 bispecific molecule is useful for targeting cells (e.g., tumor cells) that express MUC16 (e.g., ovarian tumors), and the anti-CD3 portion of the bispecific molecule is useful for activating T-cells. The simultaneous binding of MUC16 on a tumor cell and CD3 on a T-cell facilitates directed killing (cell lysis) of the targeted tumor cell by the activated T-cell. The anti-MUC16/anti-CD3 bispecific molecules of the invention are therefore useful, inter alia, for treating diseases and disorders related to or caused by MUC16-expressing tumors (e.g., ovarian cancers).

The bispecific antigen-binding molecules according to this aspect of the present invention comprise a first antigen-binding domain that specifically binds human CD3, and a second antigen-binding domain that specifically binds MUC16. The present invention includes anti-MUC16/anti-CD3 bispecific molecules (e.g., bispecific antibodies) wherein each antigen-binding domain comprises a heavy chain variable region (HCVR) paired with a light chain variable region (LCVR). In certain exemplary embodiments of the invention, the anti-CD3 antigen-binding domain and the anti-MUC16 antigen binding domain each comprise different, distinct HCVRs paired with a common LCVR. For example, as illustrated in Example 3 herein, bispecific antibodies were constructed comprising a first antigen-binding domain that specifically binds CD3, wherein the first antigen-binding domain comprises an HCVR derived from an anti-CD3 antibody paired with an LCVR derived from an anti-MUC16 antibody (e.g., the same LCVR that is included in the anti-MUC16 antigen-binding domain); and a second antigen-binding domain that specifically binds MUC16, wherein the second antigen-binding domain comprises an HCVR/LCVR derived from an anti-MUC16 antibody. In other words, in the exemplary molecules disclosed herein, the pairing of an HCVR from an anti-CD3 antibody with an LCVR from an anti-MUC16 antibody creates an antigen-binding domain that specifically binds CD3 (but does not bind MUC16). In such embodiments, the first and second antigen-binding domains comprise distinct anti-CD3 and anti-MUC16 HCVRs but share a common anti-MUC16 LCVR. In other embodiments, the bispecific antigen-binding molecules comprise distinct anti-CD3 and anti-MUC16 HCVRs, but share a common LCVR. The amino acid sequence of this LCVR is shown, e.g., in SEQ ID NO:1890, and the amino acid sequences of the corresponding CDRs (i.e., LCDR1-LCDR2-LCDR3) are shown in SEQ ID NOs: 1892, 1894 and 1896, respectively. Genetically modified mice can be used to produce fully human bispecific antigen-binding molecules comprising two different heavy chains that associate with an identical light chain that comprises a variable domain derived from one of two different human light chain variable region gene segments. Alternatively, variable heavy chains may be paired with one common light chain and expressed recombinantly in host cells. As such, the antibodies of the invention can comprise immunoglobulin heavy chains associated with a single rearranged light chain. In some embodiments, the light chain comprises a variable domain derived from a human Vκ1-39 gene segment or a Vκ3-20 gene segment. In other embodiments, the light chain comprises a variable domain derived from a human Vκ1-39 gene segment rearranged with a human Jκ5 or a human Jκ1 gene segment.

The present invention provides anti-CD3/anti-MUC16 bispecific molecules, wherein the first antigen-binding domain that specifically binds CD3 comprises any of the HCVR amino acid sequences, any of the LCVR amino acid sequences, any of the HCVR/LCVR amino acid sequence pairs, any of the heavy chain CDR1-CDR2-CDR3 amino acid sequences, or any of the light chain CDR1-CDR2-CDR3 amino acid sequences as set forth in US publication 2014/0088295 published Mar. 27, 2014 and PCT/US2016/044732 filed Jul. 29, 2016.

In addition, the present invention provides anti-CD3/anti-MUC16 bispecific molecules, wherein the first antigen-binding domain that specifically binds CD3 comprises any of the HCVR amino acid sequences as set forth in Tables 16, 18, and 22 herein. The first antigen-binding domain that specifically binds CD3 may also comprise any of the LCVR amino acid sequences as set forth in Tables 1, 16, 19, and 23 herein. According to certain embodiments, the first antigen-binding domain that specifically binds CD3 comprises any of the HCVR/LCVR amino acid sequence pairs as set forth in Tables 16, 18, 19, 22, and 23 herein. The present invention also provides anti-CD3/anti-MUC16 bispecific molecules, wherein the first antigen-binding domain that specifically binds CD3 comprises any of the heavy chain CDR1-CDR2-CDR3 amino acid sequences as set forth in Tables 16, 18, and 22 herein, and/or any of the light chain CDR1-CDR2-CDR3 amino acid sequences as set forth in Tables 1, 16, 19, and 23 herein.

According to certain embodiments, the present invention provides anti-CD3/anti-MUC16 bispecific molecules, wherein the first antigen-binding domain that specifically binds CD3 comprises a heavy chain variable region (HCVR) having an amino acid sequence as set forth in Tables 16, 18, and 22 herein or a substantially similar sequence thereof having at least 90%, at least 95%, at least 98% or at least 99% sequence identity.

The present invention also provides anti-CD3/anti-MUC16 bispecific molecules, wherein the first antigen-binding domain that specifically binds CD3 comprises a light chain variable region (LCVR) having an amino acid sequence as set forth in Tables 1, 6, 19, and 23 herein, or a substantially similar sequence thereof having at least 90%, at least 95%, at least 98% or at least 99% sequence identity.

The present invention also provides anti-CD3/anti-MUC16 bispecific molecules, wherein the first antigen-binding domain that specifically binds CD3 comprises a HCVR and LCVR (HCVR/LCVR) amino acid sequence pair as set forth in Tables 16, 18, 19, 22, and 23 herein.

The present invention also provides anti-CD3/anti-MUC16 bispecific molecules, wherein the first antigen-binding domain that specifically binds CD3 comprises a heavy chain CDR3 (HCDR3) domain having an amino acid sequence as set forth in Tables 16, 18, and 22 herein, or a substantially similar sequence thereto having at least 90%, at least 95%, at least 98% or at least 99% sequence identity; and a light chain CDR3 (LCDR3) domain having an amino acid sequence as set forth in Tables 1, 16, 19, and 23 herein, or a substantially similar sequence thereof having at least 90%, at least 95%, at least 98% or at least 99% sequence identity.

In certain embodiments, the first antigen-binding domain that specifically binds CD3 comprises a HCDR3/LCDR3 amino acid sequence pair as set forth in Tables 16, 18, 19, 22, and 23 herein.

The present invention also provides anti-CD3/anti-MUC16 bispecific antigen-binding molecules, wherein the first antigen-binding domain that specifically binds CD3 comprises a heavy chain CDR1 (HCDR1) domain having an amino acid as set forth in Tables 16, 18, and 22 herein, or a substantially similar sequence thereof having at least 90%, at least 95%, at least 98% or at least 99% sequence identity; a heavy chain CDR2 (HCDR2) domain having an amino acid as set forth in Tables 16, 18, and 22, or a substantially similar sequence thereof having at least 90%, at least 95%, at least 98% or at least 99% sequence identity; a heavy chain CDR3 (HCDR3) domain having an amino acid as set forth in Tables 16, 18, and 22, or a substantially similar sequence thereof having at least 90%, at least 95%, at least 98% or at least 99% sequence identity; a light chain CDR1 (LCDR1) domain having an amino acid sequence as set forth in Tables 1, 16, 19, and 23 herein, or a substantially similar sequence thereof having at least 90%, at least 95%, at least 98% or at least 99% sequence identity; a light chain CDR2 (LCDR2) domain having an amino acid sequence as set forth in Tables 1, 16, 19, and 23 herein, or a substantially similar sequence thereof having at least 90%, at least 95%, at least 98% or at least 99% sequence identity, and a light chain CDR3 (LCDR3) domain having an amino acid sequence as set forth in Tables 1, 16, 19, and 23 herein, or a substantially similar sequence thereof having at least 90%, at least 95%, at least 98% or at least 99% sequence identity.

Certain non-limiting, exemplary anti-CD3/anti-MUC16 bispecific antigen-binding molecules of the invention include a first antigen-binding domain that specifically binds CD3 comprising HCDR1-HCDR2-HCDR3-LCDR1-LCDR2-LCDR3 domains, respectively, having the amino acid sequences as set forth in Tables 16, 18, 19, 22, and 23 herein.

The present invention further provides a bispecific antigen-binding molecule, wherein the first antigen-binding domain that specifically binds human CD3 comprises heavy chain complementarity determining regions (HCDR1, HCDR2 and HCDR3) from a heavy chain variable region (HCVR) comprising an amino acid sequence as set forth in Table 16, Table 18, or Table 22 and light chain complementarity determining regions (LCDR1, LCDR2 and LCDR3) from a light chain variable region (LCVR) comprising an amino acid sequence as set forth in Table 1, Table 16, Table 19 or Table 23.

In another aspect, the invention provides a bispecific antigen-binding molecule wherein the first antigen-binding domain that specifically binds human CD3 comprises heavy chain complementarity determining regions (HCDR1, HCDR2 and HCDR3) from a heavy chain variable region (HCVR) selected from the group consisting of SEQ ID NOs:

1730, 1762, 1778, 1786, and 1866, and light chain complementarity determining regions (LCDR1, LCDR2 and LCDR3) from a light chain variable region (LCVR) comprising an amino acid sequence of SEQ ID NO: 26.

The invention further provides a bispecific antigen-binding molecule, wherein the first antigen-binding domain that specifically binds human CD3 comprises three heavy chain complementarity determining regions (A1-HCDR1, A1-HCDR2 and A1-HCDR3) and three light chain complementarity determining regions (A1-LCDR1, A1-LCDR2 and A1-LCDR3), wherein A1-HCDR1 comprises an amino acid sequence selected from the group consisting of SEQ ID NOs: 1732, 1764, 1780, 1788, and 1868; A1-HCDR2 comprises an amino acid sequence selected from the group consisting of SEQ ID NOs: 1734, 1766, 1782, 1790, and 1870; A1-HCDR3 comprises an amino acid sequence selected from the group consisting of SEQ ID NOs: 1736, 1768, 1784, 1792, and 1872; A1-LCDR1 comprises an amino acid sequence of SEQ ID NO:28; A1-LCDR2 comprises an amino acid sequence of SEQ ID NO:30; and A1-LCDR3 comprises an amino acid sequence of SEQ ID NO:32.

In a further aspect, the invention provides a bispecific antigen-binding molecule, wherein the first antigen-binding domain that specifically binds human CD3 comprises the heavy and light chain CDRs of a HCVR/LCVR amino acid sequence pair selected from the group consisting of: SEQ ID NOs: 1730/26, 1762/26, 1778/26, 1786/26, and 1866/26

In another aspect, the invention provides a bispecific antigen-binding molecule, wherein the first antigen-binding domain that specifically binds human CD3 comprises three heavy chain complementarity determining regions (A1-HCDR1, A1-HCDR2 and A1-HCDR3) and three light chain complementarity determining regions (A1-LCDR1, A1-LCDR2 and A1-LCDR3), and wherein the second antigen-binding domain that specifically binds human MUC16 comprises three heavy chain complementarity determining regions (A2-HCDR1, A2-HCDR2 and A2-HCDR3) and three light chain complementarity determining regions (A2-LCDR1, A2-LCDR2 and A2-LCDR3); wherein A1-HCDR1 comprises an amino acid sequence selected from the group consisting of SEQ ID NOs: 1732, 1764, 1780, 1788, and 1868; A1-HCDR2 comprises an amino acid sequence selected from the group consisting of SEQ ID NOs: 1734, 1766, 1782, 1790, and 1870; A1-HCDR3 comprises an amino acid sequence selected from the group consisting of SEQ ID NOs: 1736, 1768, 1784, 1792, and 1872; A1-LCDR1 comprises an amino acid sequence of SEQ ID NO:28; A1-LCDR2 comprises an amino acid sequence of SEQ ID NO:30; and A1-LCDR3 comprises an amino acid sequence of SEQ ID NO:32; and wherein A2-HCDR1 comprises an amino acid sequence of SEQ ID NO:20; A2-HCDR2 comprises an amino acid sequence of SEQ ID NO:22; A2-HCDR3 comprises an amino acid sequence of SEQ ID NO:24; A2-LCDR1 comprises an amino acid sequence of SEQ ID NO:28; A2-LCDR2 comprises an amino acid sequence of SEQ ID NO:30; and A2-LCDR3 comprises an amino acid sequence of SEQ ID NO:32.

Certain non-limiting, exemplary anti-CD3/anti-MUC16 bispecific antigen-binding molecules of the invention include a first antigen-binding domain that specifically binds CD3 comprising a heavy chain comprising variable domain framework regions having an amino acid sequence selected from FR1 (SEQ ID NO: 1903), FR2 (SEQ ID NO: 1904), FR3 (SEQ ID NO: 1905), and FR4 (SEQ ID NO: 1906).

In more embodiments, exemplary anti-CD3/anti-MUC16 bispecific antigen-binding molecules of the invention include a bispecific antigen-binding molecule wherein the first antigen-binding domain that specifically binds human CD3 comprises a HCVR comprising HCDR1-HCDR2-HCDR3 having the amino acid sequences of SEQ ID NOs: 1907-1908-1909.

The present invention also provides anti-CD3/anti-MUC16 bispecific molecules, wherein the second antigen-binding domain that specifically binds MUC16 comprises a heavy chain variable region (HCVR) having the amino acid sequence selected from the group consisting of SEQ ID NOs: 2, 18, 34, 50, 66, 82, 98, 114, 130, 146, 162, 178, 194, 202, 218, 234, 250, 258, 274, 282, 298, 314, 330, 346, 362, and 378, or a substantially similar sequence thereof having at least 90%, at least 95%, at least 98% or at least 99% sequence identity.

The present invention also provides anti-CD3/anti-MUC16 bispecific molecules, wherein the second antigen-binding domain that specifically binds MUC16 comprises a light chain variable region (LCVR) having the amino acid sequence selected from the group consisting of SEQ ID NOs: 10; 26; 42; 58; 74; 90; 106; 122; 138; 154; 170; 186; 210; 226; 242; 266; 290; 306; 322; 338; 354; 370; 386; 1936; and 394, or a substantially similar sequence thereof having at least 90%, at least 95%, at least 98% or at least 99% sequence identity.

The present invention also provides anti-CD3/anti-MUC16 bispecific molecules, wherein the second antigen-binding domain that specifically binds MUC16 comprises a HCVR and LCVR (HCVR/LCVR) amino acid sequence pair selected from the group consisting of SEQ ID NOs: 18/26.

The present invention also provides anti-CD3/anti-MUC16 bispecific molecules, wherein the second antigen-binding domain that specifically binds MUC16 comprises a heavy chain CDR3 (HCDR3) domain having an amino acid sequence selected from the group consisting of SEQ ID NOs: 8, 24, 40, 56, 72, 88, 104, 120, 136, 152, 168, 184, 200, 208, 224, 240, 256, 264, 280, 288, 304, 320, 336, 352, 368, and 384, or a substantially similar sequence thereto having at least 90%, at least 95%, at least 98% or at least 99% sequence identity; and a light chain CDR3 (LCDR3) domain having an amino acid sequence selected from the group consisting of SEQ ID NOs: 16, 32, 48, 64, 80, 96, 112, 128, 144, 160, 176, 192, 216, 232, 248, 272, 296, 312, 328, 344, 360, 376, 392, 400, and 1942, or a substantially similar sequence thereof having at least 90%, at least 95%, at least 98% or at least 99% sequence identity.

In certain embodiments, the second antigen-binding domain that specifically binds MUC16 comprises a HCDR3/LCDR3 amino acid sequence pair selected from the group consisting of SEQ ID NOs: 24/32.

The present invention also provides anti-CD3/anti-MUC16 bispecific antigen-binding molecules, wherein the second antigen-binding domain that specifically binds MUC16 comprises a heavy chain CDR1 (HCDR1) domain having an amino acid sequence selected from the group consisting of SEQ ID NOs: 4, 20, 36, 52, 68, 84, 100, 116, 132, 148, 164, 180, 196, 204, 220, 236, 252, 260, 276, 284, 300, 316, 332, 348, 364, and 380, or a substantially similar sequence thereof having at least 90%, at least 95%, at least 98% or at least 99% sequence identity; a heavy chain CDR2 (HCDR2) domain having an amino acid sequence selected from the group consisting of SEQ ID NOs: 6, 22, 38, 54, 70, 86, 102, 118, 134, 150, 166, 182, 198, 206, 222, 238, 254, 262, 278, 286, 302, 318, 334, 350, 366, and 382, or a substantially similar sequence thereof having at least 90%, at least 95%, at least 98% or at least 99% sequence identity;

a heavy chain CDR3 (HCDR3) domain having an amino acid sequence selected from the group consisting of SEQ ID NOs: 8, 24, 40, 56, 72, 88, 104, 120, 136, 152, 168, 184, 200, 208, 224, 240, 256, 264, 280, 304, 320, 336, 352, 368, and 384, or a substantially similar sequence thereof having at least 90%, at least 95%, at least 98% or at least 99% sequence identity; a light chain CDR1 (LCDR1) domain having an amino acid sequence selected from the group consisting of SEQ ID NOs: 12, 28, 44, 60, 76, 92, 108, 124, 140, 156, 172, 188, 396, 212, 228, 244, 396, 268, 396, 292, 308, 324, 340, 356, 372, 1938, and 388, or a substantially similar sequence thereof having at least 90%, at least 95%, at least 98% or at least 99% sequence identity; and a light chain CDR2 (LCDR2) domain having an amino acid sequence selected from the group consisting of SEQ ID NOs: 14, 30, 46, 62, 78, 94, 110, 126, 142, 158, 174, 190, 398, 214, 230, 246, 398, 270, 398, 294, 310, 326, 342, 358, 374, 1940, and 390, or a substantially similar sequence thereof having at least 90%, at least 95%, at least 98% or at least 99% sequence identity; and a light chain CDR3 (LCDR3) domain having an amino acid sequence selected from the group consisting of SEQ ID NOs: 16, 32, 48, 64, 80, 96, 112, 128, 144, 160, 176, 192, 400, 216, 232, 248, 400, 272, 400, 296, 312, 328, 344, 360, 376, 1942, and 392, or a substantially similar sequence thereof having at least 90%, at least 95%, at least 98% or at least 99% sequence identity.

Certain non-limiting, exemplary anti-CD3/anti-MUC16 bispecific antigen-binding molecules of the invention include a second antigen-binding domain that specifically binds MUC16 comprising HCDR1-HCDR2-HCDR3-LCDR1-LCDR2-LCDR3 domains, respectively, having the amino acid sequences selected from the group consisting of: SEQ ID NOs: 20-22-24-28-30-32.

In a related embodiment, the invention includes anti-CD3/anti-MUC16 bispecific antigen-binding molecules wherein the second antigen-binding domain that specifically binds MUC16 comprises the heavy and light chain CDR domains contained within heavy and light chain variable region (HCVR/LCVR) sequences selected from the group consisting of SEQ ID NOs: 18/26.

In one embodiment, the invention provides an anti-CD3/anti-MUC16 bispecific antibody, comprising an anti-MUC16 binding arm that comprises a heavy chain comprising the amino acid sequence of SEQ ID NO: 1959 and a light chain comprising the amino acid sequence of SEQ ID NO: 1960, and an anti-CD3 binding arm that comprises a heavy chain comprising the amino acid sequence of SEQ ID NO: 1961 and a light chain comprising the amino acid sequence of SEQ ID NO: 1960. In another embodiment, the invention provides an anti-CD3/anti-MUC16 bispecific antibody, comprising an anti-MUC16 binding arm that comprises a heavy chain comprising the amino acid sequence of SEQ ID NO: 1959 and a light chain comprising the amino acid sequence of SEQ ID NO: 1960, and an anti-CD3 binding arm that comprises a heavy chain comprising the amino acid sequence of SEQ ID NO: 1962 and a light chain comprising the amino acid sequence of SEQ ID NO: 1960.

In another aspect, the invention provides a bispecific antigen-binding molecule comprising a first antigen-binding domain that binds human CD3 and a second antigen-binding domain that binds human MUC16, wherein the second antigen-binding domain is derived from the antibody or antigen-binding fragment of any one of the anti-MUC16 antibodies of the invention. In a further aspect, the invention provides a bispecific antigen-binding molecule comprising a first antigen-binding domain that specifically binds human CD3, and a second antigen-binding domain that specifically binds human MUC16.

The invention further provides a bispecific antigen-binding molecule which binds human cells expressing human CD3 and cynomolgus monkey cells expressing cynomolgus CD3. In another aspect, the bispecific antigen-binding molecule binds human cells expressing human MUC16.

In another aspect the invention provides a bispecific antigen-binding molecule which inhibits tumor growth in immunocompromised mice bearing human ovarian cancer xenografts. The invention further provides a bispecific antigen-binding molecule which suppresses tumor growth of established tumors in immunocompromised mice bearing human ovarian cancer xenografts.

In another aspect the invention provides a bispecific antigen-binding molecule comprising i) a first antigen-binding domain that specifically binds an effector cell with an $EC_{50}$ value of greater than about 4 nM and, and ii) a second antigen-binding domain that specifically binds a target human ovarian tumor cell with an $EC_{50}$ value of less than 3 nM, wherein such $EC_{50}$ binding value is measured in an in vitro FACS binding assay.

In one embodiment, the bispecific antigen-binding molecule can include a second antigen-binding domain that specifically binds the target ovarian tumor cell with an $EC_{50}$ value of less than about 2 nM. In some cases, the first antigen-binding domain specifically binds each of human CD3 and cynomolgus CD3 with an $EC_{50}$ value of greater than about 40 nM, greater than about 100 nM, greater than about 200 nM, greater than about 300 nM, greater than about 400 nM, greater than about 500 nM, or greater than about 1 μM. In some cases, the first antigen-binding domain specifically binds each of human CD3 and cynomolgus CD3 with weak or no measurable binding or binding affinity.

In some embodiments, the antigen-binding molecule induces T cell-mediated tumor cell killing with an $EC_{50}$ value of less than about 31 μM, as measured in an in vitro T cell-mediated tumor cell killing assay, for example, where the tumor cells are OVCAR3 cells.

In some applications, the first antigen-binding domain binds human CD3 with an $K_D$ value of greater than about 11 nM, as measured in an in vitro surface plasmon resonance binding assay. In some instances, the first antigen-binding domain binds each of human CD3 and cynomolgus CD3 with an $K_D$ value of greater than about 15 nM, greater than about 30 nM, greater than about 60 nM, greater than about 120 nM, greater than about 300 nM, or greater than about 500 nM as measured in an in vitro surface plasmon resonance binding assay.

In certain embodiments, anti-CD3 antibodies of the invention, antigen-binding fragments and bispecific antibodies thereof were made by replacing amino acid residues of a parental in a stepwise manner based on differences between the germline sequence and the parental antibody sequence.

In some embodiments, the invention provides a bispecific antigen-binding molecule, wherein the second antigen-binding domain competes for binding to human MUC16 with a reference antigen-binding protein comprising three heavy chain complementarity determining regions (A2-HCDR1, A2-HCDR2 and A2-HCDR3) and three light chain complementarity determining regions (A2-LCDR1, A2-LCDR2 and A2-LCDR3), wherein A2-HCDR1 comprises an amino acid sequence of SEQ ID NO: 20; A2-HCDR2 comprises an amino acid sequence of SEQ ID NO: 22; A2-HCDR3 comprises an amino acid sequence of SEQ ID NO: 24;

A2-LCDR1 comprises an amino acid sequence of SEQ ID NO: 28; A2-LCDR2 comprises an amino acid sequence of SEQ ID NO: 30; and A2-LCDR3 comprises an amino acid sequence of SEQ ID NO:32. In some embodiments, the invention provides a bispecific antigen-binding molecule, wherein the second antigen-binding domain competes for binding to human MUC16 with a reference antigen-binding protein comprising a heavy chain variable region (HCVR) comprising an amino acid sequence of SEQ ID NO: 18, and a light chain variable region (LCVR) comprising an amino acid sequence SEQ ID NO: 26.

In some embodiments, the invention provides a bispecific antigen-binding molecule, wherein the first antigen-binding domain competes for binding to human CD3 with a reference antigen-binding protein comprising three heavy chain complementarity determining regions (A1-HCDR1, A1-HCDR2 and A1-HCDR3) and three light chain complementarity determining regions (A1-LCDR1, A1-LCDR2 and A1-LCDR3), A1-HCDR1 comprises an amino acid sequence selected from the group consisting of SEQ ID NOs: 1732, 1764, 1780, 1788, and 1868; A1-HCDR2 comprises an amino acid sequence selected from the group consisting of SEQ ID NOs: 1734, 1766, 1782, 1790, and 1870; A1-HCDR3 comprises an amino acid sequence selected from the group consisting of SEQ ID NOs: 1736, 1768, 1784, 1792, and 1872; A1-LCDR1 comprises an amino acid sequence SEQ ID NO: 28; A1-LCDR2 comprises an amino acid sequence of SEQ ID NO: 30; and A1-LCDR3 comprises an amino acid sequence of SEQ ID NO: 32. In some embodiments, the invention provides a bispecific antigen-binding molecule, wherein the first antigen-binding domain competes for binding to human CD3 with a reference antigen-binding protein comprising a heavy chain variable region (HCVR) comprising an amino acid sequence selected from the group consisting of SEQ ID NOs: 1730, 1762, 1778, 1786, and 1866, and a light chain variable region (LCVR) comprising an amino acid sequence of SEQ ID NO:26.

In some embodiments, the invention provides a bispecific antigen-binding molecule, wherein the first antigen-binding domain competes for binding to human CD3 with a reference antigen-binding protein comprising a heavy chain variable region (HCVR) comprising an amino acid sequence selected from the group consisting of SEQ ID NOs: 1730, 1762, 1778, 1786, and 1866, and a light chain variable region (LCVR) comprising an amino acid sequence of SEQ ID NO:26; and wherein the second antigen-binding domain competes for binding to human MUC16 with a reference antigen-binding protein comprising a heavy chain variable region (HCVR) comprising an amino acid sequence of SEQ ID NO:18, and a light chain variable region (LCVR) comprising an amino acid sequence of SEQ ID NO: 26.

In one aspect, the invention provides a pharmaceutical composition comprising an anti-MUC16 antigen-binding molecule or anti-MUC16/anti-CD3 bispecific antigen-binding molecule and a pharmaceutically acceptable carrier or diluent. The invention further provides a method for treating a cancer in a subject, the method comprising administering to the subject the pharmaceutical composition comprising an anti-MUC16 antigen-binding molecule or anti-MUC16/anti-CD3 bispecific antigen-binding molecule and a pharmaceutically acceptable carrier or diluent. In some embodiments, the cancer is selected from the group consisting of cancers including ovarian cancer, breast cancer, pancreatic cancer, non-small-cell lung cancer, intrahepatic cholangiocarcinoma-mass forming type, adenocarcinoma of the uterine cervix, and adenocarcinoma of the gastric tract. In some cases, the cancer is ovarian cancer.

In another aspect, the present invention provides nucleic acid molecules encoding any of the HCVR, LCVR or CDR sequences of the anti-CD3/anti-MUC16 bispecific antigen-binding molecules disclosed herein, including nucleic acid molecules comprising the polynucleotide sequences as set forth in Tables 2, 17, 20, 21, 23, and 25 herein, as well as nucleic acid molecules comprising two or more of the polynucleotide sequences as set forth in Tables 2, 17, 20, 21, 23, and 25 in any functional combination or arrangement thereof. Recombinant expression vectors carrying the nucleic acids of the invention, and host cells into which such vectors have been introduced, are also encompassed by the invention, as are methods of producing the antibodies by culturing the host cells under conditions permitting production of the antibodies, and recovering the antibodies produced.

The present invention includes anti-CD3/anti-MUC16 bispecific antigen-binding molecules wherein any of the aforementioned antigen-binding domains that specifically bind CD3 are combined, connected or otherwise associated with any of the aforementioned antigen-binding domains that specifically bind MUC16 to form a bispecific antigen-binding molecule that binds CD3 and MUC16.

The present invention includes anti-CD3/anti-MUC16 bispecific antigen-binding molecules having a modified glycosylation pattern. In some applications, modification to remove undesirable glycosylation sites may be useful, or an antibody lacking a fucose moiety present on the oligosaccharide chain, for example, to increase antibody dependent cellular cytotoxicity (ADCC) function (see Shield et al. (2002) JBC 277:26733). In other applications, modification of galactosylation can be made in order to modify complement dependent cytotoxicity (CDC).

In another aspect, the invention provides a pharmaceutical composition comprising an anti-CD3/anti-MUC16 bispecific antigen-binding molecule as disclosed herein and a pharmaceutically acceptable carrier. In a related aspect, the invention features a composition which is a combination of an anti-CD3/anti-MUC16 bispecific antigen-binding molecule and a second therapeutic agent. In one embodiment, the second therapeutic agent is any agent that is advantageously combined with an anti-CD3/anti-MUC16 bispecific antigen-binding molecule. Exemplary agents that may be advantageously combined with an anti-CD3/anti-MUC16 bispecific antigen-binding molecule are discussed in detail elsewhere herein.

In yet another aspect, the invention provides therapeutic methods for targeting/killing tumor cells expressing MUC16 using an anti-CD3/anti-MUC16 bispecific antigen-binding molecule of the invention, wherein the therapeutic methods comprise administering a therapeutically effective amount of a pharmaceutical composition comprising an anti-CD3/anti-MUC16 bispecific antigen-binding molecule of the invention to a subject in need thereof.

The present invention also includes the use of an anti-CD3/anti-MUC16 bispecific antigen-binding molecule of the invention in the manufacture of a medicament for the treatment of a disease or disorder related to or caused by MUC16-expressing cells.

In another aspect, the present invention provides a method of detecting MUC16 in a biological sample, comprising: obtaining a biological sample from a subject, and detecting whether MUC16 is present in the biological sample by contacting the biological sample with an anti-MUC16 antibody or antigen-binding fragment thereof and detecting binding between MUC16 and the anti-MUC16 antibody or antigen-binding fragment. In some cases, the biological sample is a tissue or fluid sample selected from plasma, serum, ascites, ovary, uterus, cervix, liver, bladder, pancreas, stomach, small or large intestine, gall bladder, breast, lung, kidney, salivary, and lacrimal glands, or any epithelioid malignancy thereof. In some embodiments, the antibody or antigen-binding fragment binds human MUC16 within one or more of five membrane-proximal SEA domains of human MUC16 corresponding to residues 13791-14451 of SEQ ID NO: 1899. In some embodiments, the antibody or antigen-binding fragment binds human MUC16 within residues 13810-14451 of SEQ ID NO: 1899. In some embodiments, the antibody or antigen-binding fragment binds to any one of more of SEA1, SEA2, SEA3, SEA4, SEA5, SEA6, SEA7, SEA8, SEA9, SEA10, SEA11, SEA12, SEA13, SEA14, SEA15 or SEA16 of human MUC16.

In another aspect, the invention provides a method of detecting MUC16 in a patient, comprising: obtaining a tissue sample from the patient; and detecting whether MUC16 is present in the tissue sample by contacting the tissue sample with an anti-MUC16 antibody and detecting binding between MUC16 and the anti-MUC16 antibody. In some cases, the method further comprises diagnosing the patient with a cancer when the presence of MUC16 in the tissue sample is detected. In one embodiment, the tissue sample is ovarian tissue. In some cases, the anti-MUC16 antibody is specific for an epitope within residues 12783-13467 of SEQ ID NO: 1899. In one embodiment, the anti-MUC16 antibody comprises CDRs of a HCVR/LCVR pair comprising the amino acid sequences of SEQ ID NO: 202/210. In some cases, the anti-MUC16 antibody is specific for an epitope within residues 13810-14451 of SEQ ID NO: 1899. In one embodiment, the anti-MUC16 antibody comprises CDRs of a HCVR/LCVR amino acid sequence pair selected from the group consisting of SEQ ID NO: 250/1936, 258/266, 314/322 and 1944/1952.

In another aspect, the invention provides a method of detecting MUC16 in a patient, comprising: obtaining a plasma sample from the patient; and detecting whether MUC16 is present in the plasma sample by contacting the plasma sample with an anti-MUC16 antibody comprising CDRs of a HCVR/LCVR pair comprising the amino acid sequences of SEQ ID NO: 202/210, and detecting binding between MUC16 and the anti-MUC16 antibody. In some cases, the method further comprises diagnosing the patient with a cancer when the presence of MUC16 in the plasma sample is detected. In some embodiments, the method further comprises administering an effective amount of an anti-CD3×MUC16 bispecific antibody to the diagnosed patient. In some embodiments, the method further comprises administering an effective amount of an ADC comprising an anti-MUC16 antibody or antigen-binding fragment thereof and a cytotoxic agent to the diagnosed patient.

In another aspect, the invention provides an isolated antibody or antigen-binding fragment thereof that binds MUC16, wherein the antibody or antigen-binding fragment comprises CDRs of a HCVR/LCVR amino acid sequence pair selected from the group consisting of SEQ ID NO: 202/210, 250/1936, 258/266, 314/322, 82/858, 98/170, and 1944/1952. In some embodiments, the antibody or antigen-binding fragment thereof comprises HCDR1-HCDR2-HCDR3-LCDR1-LCDR2-LCDR3 domains, respectively, selected from the group consisting of SEQ ID NOs: 204-206-208-212-214-216; 252-254-256-1938-1940-1942; 260-262-264-268-270-272; 316-318-320-324-326-328; 84-86-88-1892-1894-1896; 100-102-104-172-174-176; and 1946-1948-1950-1954-1956-1958. In some embodiments, the antibody or antigen-binding fragment comprises a HCVR/LCVR amino acid sequence pair selected from the group consisting of 202/210, 250/1936, 258/266, 314/322, 82/858, 98/170, and 1944/1952.

Other embodiments will become apparent from a review of the ensuing detailed description.

DETAILED DESCRIPTION

Figure 1:
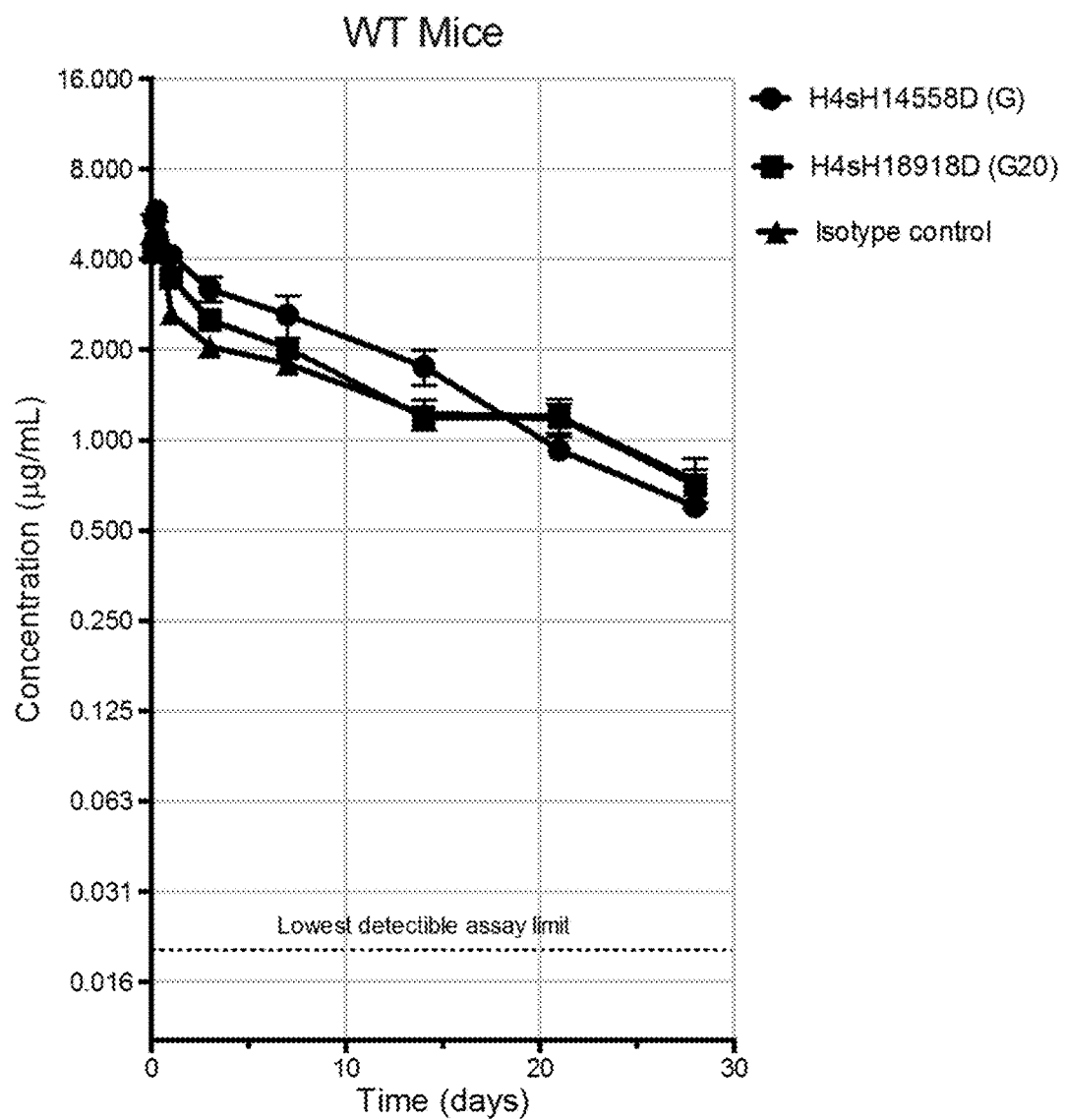
FIGS. 1, 2, and 3 illustrate pharmacokinetic profiles of anti-MUC16×CD3 bispecific antibodies in wild-type mice (FIG. 1), humanized CD3 mice (FIG. 2) or humanized MUC16×CD3 mice (FIG. 3).

Before the present invention is described, it is to be understood that this invention is not limited to particular methods and experimental conditions described, as such methods and conditions may vary. It is also to be understood that the terminology used herein is for the purpose of describing particular embodiments only, and is not intended to be limiting, since the scope of the present invention will be limited only by the appended claims.

Unless defined otherwise, all technical and scientific terms used herein have the same meaning as commonly understood by one of ordinary skill in the art to which this invention belongs. As used herein, the term "about," when used in reference to a particular recited numerical value, means that the value may vary from the recited value by no more than 1%. For example, as used herein, the expression "about 100" includes 99 and 101 and all values in between (e.g., 99.1, 99.2, 99.3, 99.4, etc.).

Although any methods and materials similar or equivalent to those described herein can be used in the practice or testing of the present invention, the preferred methods and materials are now described. All patents, applications and non-patent publications mentioned in this specification are incorporated herein by reference in their entireties.

Definitions

The expression "CD3," as used herein, refers to an antigen which is expressed on T cells as part of the multi-molecular T cell receptor (TCR) and which consists of a homodimer or heterodimer formed from the association of two of four receptor chains: CD3-epsilon, CD3-delta, CD3-zeta, and CD3-gamma. Human CD3-epsilon comprises the amino acid sequence as set forth in SEQ ID NO:1897; human CD3-delta comprises the amino acid sequence as set forth in SEQ ID NO:1898. All references to proteins, polypeptides and protein fragments herein are intended to refer to the human version of the respective protein, polypeptide or protein fragment unless explicitly specified as being from a non-human species. Thus, the expression "CD3" means human CD3 unless specified as being from a non-human species, e.g., "mouse CD3," "monkey CD3," etc.

As used herein, "an antibody that binds CD3" or an "anti-CD3 antibody" includes antibodies and antigen-binding fragments thereof that specifically recognize a single CD3 subunit (e.g., epsilon, delta, gamma or zeta), as well as antibodies and antigen-binding fragments thereof that specifically recognize a dimeric complex of two CD3 subunits (e.g., gamma/epsilon, delta/epsilon, and zeta/zeta CD3 dimers). The antibodies and antigen-binding fragments of the present invention may bind soluble CD3 and/or cell surface expressed CD3. Soluble CD3 includes natural CD3 proteins as well as recombinant CD3 protein variants such as, e.g., monomeric and dimeric CD3 constructs, that lack a transmembrane domain or are otherwise unassociated with a cell membrane.

As used herein, the expression "cell surface-expressed CD3" means one or more CD3 protein(s) that is/are expressed on the surface of a cell in vitro or in vivo, such that at least a portion of a CD3 protein is exposed to the extracellular side of the cell membrane and is accessible to an antigen-binding portion of an antibody. "Cell surface-expressed CD3" includes CD3 proteins contained within the context of a functional T cell receptor in the membrane of a cell. The expression "cell surface-expressed CD3" includes CD3 protein expressed as part of a homodimer or heterodimer on the surface of a cell (e.g., gamma/epsilon, delta/epsilon, and zeta/zeta CD3 dimers). The expression, "cell surface-expressed CD3" also includes a CD3 chain (e.g., CD3-epsilon, CD3-delta or CD3-gamma) that is expressed by itself, without other CD3 chain types, on the surface of a cell. A "cell surface-expressed CD3" can comprise or consist of a CD3 protein expressed on the surface of a cell which normally expresses CD3 protein. Alternatively, "cell surface-expressed CD3" can comprise or consist of CD3 protein expressed on the surface of a cell that normally does not express human CD3 on its surface but has been artificially engineered to express CD3 on its surface.

The expression "MUC16," as used herein, refers to mucin 16. MUC16 is a single transmembrane domain highly glycosylated integral membrane glycoprotein that is highly expressed in ovarian cancer. The amino acid sequence of human MUC16 is set forth in SEQ ID NO:1899.

As used herein, "an antibody that binds MUC16" or an "anti-MUC16 antibody" includes antibodies and antigen-binding fragments thereof that specifically recognize MUC16.

The term "antigen-binding molecule" includes antibodies and antigen-binding fragments of antibodies, including, e.g., bispecific antibodies.

The term "antibody", as used herein, means any antigen-binding molecule or molecular complex comprising at least one complementarity determining region (CDR) that specifically binds to or interacts with a particular antigen (e.g., MUC16 or CD3). The term "antibody" includes immunoglobulin molecules comprising four polypeptide chains, two heavy (H) chains and two light (L) chains inter-connected by disulfide bonds, as well as multimers thereof (e.g., IgM). Each heavy chain comprises a heavy chain variable region (abbreviated herein as HCVR or $V_H$) and a heavy chain constant region. The heavy chain constant region comprises three domains, $C_H1$, $C_H2$ and $C_H3$. Each light chain comprises a light chain variable region (abbreviated herein as LCVR or $V_L$) and a light chain constant region. The light chain constant region comprises one domain ($C_L1$). The $V_H$ and $V_L$ regions can be further subdivided into regions of hypervariability, termed complementarity determining regions (CDRs), interspersed with regions that are more conserved, termed framework regions (FR). Each $V_H$ and $V_L$ is composed of three CDRs and four FRs, arranged from amino-terminus to carboxy-terminus in the following order: FR1, CDR1, FR2, CDR2, FR3, CDR3, FR4. In different embodiments of the invention, the FRs of the anti-MUC16 antibody or anti-CD3 antibody (or antigen-binding portion thereof) may be identical to the human germline sequences, or may be naturally or artificially modified. An amino acid consensus sequence may be defined based on a side-by-side analysis of two or more CDRs.

The term "antibody", as used herein, also includes antigen-binding fragments of full antibody molecules. The terms "antigen-binding portion" of an antibody, "antigen-binding fragment" of an antibody, and the like, as used herein, include any naturally occurring, enzymatically obtainable, synthetic, or genetically engineered polypeptide or glycoprotein that specifically binds an antigen to form a complex. Antigen-binding fragments of an antibody may be derived, e.g., from full antibody molecules using any suitable standard techniques such as proteolytic digestion or recombinant genetic engineering techniques involving the manipulation and expression of DNA encoding antibody variable and optionally constant domains. Such DNA is known and/or is readily available from, e.g., commercial sources, DNA libraries (including, e.g., phage-antibody libraries), or can be synthesized. The DNA may be sequenced and manipulated chemically or by using molecular biology techniques, for example, to arrange one or more variable and/or constant domains into a suitable configuration, or to introduce codons, create cysteine residues, modify, add or delete amino acids, etc.

Non-limiting examples of antigen-binding fragments include: (i) Fab fragments; (ii) F(ab')2 fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g. monovalent nanobodies, bivalent nanobodies, etc.), small modular immunopharmaceuticals (SMIPs), and shark variable IgNAR domains, are also encompassed within the expression "antigen-binding fragment," as used herein.

An antigen-binding fragment of an antibody will typically comprise at least one variable domain. The variable domain may be of any size or amino acid composition and will generally comprise at least one CDR which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H1$; (ii) $V_H$-$C_H2$; (iii) $V_H$-$C_H3$; (iv) $V_H$-$C_H1$-$C_H2$; (v) $V_H$-$C_H1$-$C_H2$-$C_H3$; (vi) $V_H$-$C_H2$-$C_H3$; (vii) $V_H$-$C_L$; (viii) $V_L$-$C_H1$; (ix) $V_L$-$C_H2$; (x) $V_L$-$C_H3$; (xi) $V_L$-$C_H1$-$C_H2$; (xii) $V_L$-$C_H1$-$C_H2$-$C_H3$; (xiii) $V_L$-$C_H2$-$C_H3$; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids which result in a flexible or semi-flexible linkage between adjacent variable and/or constant domains in a single polypeptide molecule. Moreover, an antigen-binding fragment of an antibody of the present invention may comprise a homo-dimer or hetero-dimer (or other multimer) of any of the variable and constant domain configurations listed above in non-covalent association with one another and/or with one or more monomeric $V_H$ or $V_L$ domain (e.g., by disulfide bond(s)).

As with full antibody molecules, antigen-binding fragments may be monospecific or multispecific (e.g., bispecific). A multispecific antigen-binding fragment of an antibody will typically comprise at least two different variable domains, wherein each variable domain is capable of specifically binding to a separate antigen or to a different epitope on the same antigen. Any multispecific antibody format, including the exemplary bispecific antibody formats disclosed herein, may be adapted for use in the context of an antigen-binding fragment of an antibody of the present invention using routine techniques available in the art.

The antibodies of the present invention may function through complement-dependent cytotoxicity (CDC) or antibody-dependent cell-mediated cytotoxicity (ADCC). "Complement-dependent cytotoxicity" (CDC) refers to lysis of antigen-expressing cells by an antibody of the invention in the presence of complement. "Antibody-dependent cell-mediated cytotoxicity" (ADCC) refers to a cell-mediated reaction in which nonspecific cytotoxic cells that express Fc receptors (FcRs) (e.g., Natural Killer (NK) cells, neutrophils, and macrophages) recognize bound antibody on a target cell and thereby lead to lysis of the target cell. CDC and ADCC can be measured using assays that are well known and available in the art. (See, e.g., U.S. Pat. Nos. 5,500,362 and 5,821,337, and Clynes et al. (1998) Proc. Natl. Acad. Sci. (USA) 95:652-656). The constant region of an antibody is important in the ability of an antibody to fix complement and mediate cell-dependent cytotoxicity. Thus, the isotype of an antibody may be selected on the basis of whether it is desirable for the antibody to mediate cytotoxicity.

In certain embodiments of the invention, the anti-MUC16 monospecific antibodies or anti-MUC16/anti-CD3 bispecific antibodies of the invention are human antibodies. The term "human antibody", as used herein, is intended to include antibodies having variable and constant regions derived from human germline immunoglobulin sequences. The human antibodies of the invention may include amino acid residues not encoded by human germline immunoglobulin sequences (e.g., mutations introduced by random or site-specific mutagenesis in vitro or by somatic mutation in vivo), for example in the CDRs and in particular CDR3. However, the term "human antibody", as used herein, is not intended to include antibodies in which CDR sequences derived from the germline of another mammalian species, such as a mouse, have been grafted onto human framework sequences.

The antibodies of the invention may, in some embodiments, be recombinant human antibodies. The term "recombinant human antibody", as used herein, is intended to include all human antibodies that are prepared, expressed, created or isolated by recombinant means, such as antibodies expressed using a recombinant expression vector transfected into a host cell (described further below), antibodies isolated from a recombinant, combinatorial human antibody library (described further below), antibodies isolated from an animal (e.g., a mouse) that is transgenic for human immunoglobulin genes (see e.g., Taylor et al. (1992) Nucl. Acids Res. 20:6287-6295) or antibodies prepared, expressed, created or isolated by any other means that involves splicing of human immunoglobulin gene sequences to other DNA sequences. Such recombinant human antibodies have variable and constant regions derived from human germline immunoglobulin sequences. In certain embodiments, however, such recombinant human antibodies are subjected to in vitro mutagenesis (or, when an animal transgenic for human Ig sequences is used, in vivo somatic mutagenesis) and thus the amino acid sequences of the $V_H$ and $V_L$ regions of the recombinant antibodies are sequences that, while derived from and related to human germline $V_H$ and $V_L$ sequences, may not naturally exist within the human antibody germline repertoire in vivo.

Human antibodies can exist in two forms that are associated with hinge heterogeneity. In one form, an immunoglobulin molecule comprises a stable four chain construct of approximately 150-160 kDa in which the dimers are held together by an interchain heavy chain disulfide bond. In a second form, the dimers are not linked via inter-chain disulfide bonds and a molecule of about 75-80 kDa is formed composed of a covalently coupled light and heavy chain (half-antibody). These forms have been extremely difficult to separate, even after affinity purification.

The frequency of appearance of the second form in various intact IgG isotypes is due to, but not limited to, structural differences associated with the hinge region isotype of the antibody. A single amino acid substitution in the hinge region of the human IgG4 hinge can significantly reduce the appearance of the second form (Angal et al. (1993) Molecular Immunology 30:105) to levels typically observed using a human IgG1 hinge. The instant invention encompasses antibodies having one or more mutations in the hinge, $C_H2$ or $C_H3$ region which may be desirable, for example, in production, to improve the yield of the desired antibody form.

The antibodies of the invention may be isolated antibodies. An "isolated antibody," as used herein, means an antibody that has been identified and separated and/or recovered from at least one component of its natural environment. For example, an antibody that has been separated or removed from at least one component of an organism, or from a tissue or cell in which the antibody naturally exists or is naturally produced, is an "isolated antibody" for purposes of the present invention. An isolated antibody also includes an antibody in situ within a recombinant cell. Isolated antibodies are antibodies that have been subjected to at least one purification or isolation step. According to certain embodiments, an isolated antibody may be substantially free of other cellular material and/or chemicals.

The present invention also includes one-arm antibodies that bind MUC16. As used herein, a "one-arm antibody" means an antigen-binding molecule comprising a single antibody heavy chain and a single antibody light chain. The one-arm antibodies of the present invention may comprise any of the HCVR/LCVR or CDR amino acid sequences as set forth in Table 1.

The anti-MUC16 or anti-MUC16/anti-CD3 antibodies disclosed herein may comprise one or more amino acid substitutions, insertions and/or deletions in the framework and/or CDR regions of the heavy and light chain variable domains as compared to the corresponding germline sequences from which the antibodies were derived. Such mutations can be readily ascertained by comparing the amino acid sequences disclosed herein to germline sequences available from, for example, public antibody sequence databases. The present invention includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antibody was derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antibody was originally derived). Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be easily tested for one or more desired property such as, improved binding specificity, increased binding (e.g., as measured by cell binding titration or FACS binding) or binding affinity (e.g., $K_D$), improved or enhanced antagonistic or agonistic biological properties (as the case may be), reduced immunogenicity, etc. Antibodies and antigen-binding fragments obtained in this general manner are encompassed within the present invention.

The present invention also includes anti-MUC16 or anti-MUC16/anti-CD3 antibodies comprising variants of any of the HCVR, LCVR, and/or CDR amino acid sequences disclosed herein having one or more conservative substitutions. For example, the present invention includes anti-MUC16 or anti-MUC16/anti-CD3 antibodies having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences set forth in Table 1 herein or as described in Tables 16, 18, 19, 22, and 23 herein.

The term "epitope" refers to an antigenic determinant that interacts with a specific antigen binding site in the variable region of an antibody molecule known as a paratope. A single antigen may have more than one epitope. Thus, different antibodies may bind to different areas on an antigen and may have different biological effects. Epitopes may be either conformational or linear. A conformational epitope is produced by spatially juxtaposed amino acids from different segments of the linear polypeptide chain. A linear epitope is one produced by adjacent amino acid residues in a polypeptide chain. In certain circumstance, an epitope may include moieties of saccharides, phosphoryl groups, or sulfonyl groups on the antigen.

The term "substantial identity" or "substantially identical," when referring to a nucleic acid or fragment thereof, indicates that, when optimally aligned with appropriate nucleotide insertions or deletions with another nucleic acid (or its complementary strand), there is nucleotide sequence identity in at least about 95%, and more preferably at least about 96%, 97%, 98% or 99% of the nucleotide bases, as measured by any well-known algorithm of sequence identity, such as FASTA, BLAST or Gap, as discussed below. A nucleic acid molecule having substantial identity to a reference nucleic acid molecule may, in certain instances, encode a polypeptide having the same or substantially similar amino acid sequence as the polypeptide encoded by the reference nucleic acid molecule.

As applied to polypeptides, the term "substantial similarity" or "substantially similar" means that two peptide sequences, when optimally aligned, such as by the programs GAP or BESTFIT using default gap weights, share at least 95% sequence identity, even more preferably at least 98% or 99% sequence identity. Preferably, residue positions which are not identical differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of similarity may be adjusted upwards to correct for the conservative nature of the substitution. Means for making this adjustment are well-known to those of skill in the art. See, e.g., Pearson (1994) Methods Mol. Biol. 24: 307-331, herein incorporated by reference. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443-1445, herein incorporated by reference. A "moderately conservative" replacement is any change having a nonnegative value in the PAM250 log-likelihood matrix.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, GCG software contains programs such as Gap and Bestfit which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA using default or recommended parameters, a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215:403-410 and Altschul et al. (1997) Nucleic Acids Res. 25:3389-402, each herein incorporated by reference.

Germline Mutations

The anti-CD3 antibodies disclosed herein comprise one or more amino acid substitutions, insertions and/or deletions in the framework and/or CDR regions of the heavy chain variable domains as compared to the corresponding germline sequences from which the antibodies were derived.

The present invention also includes antibodies, and antigen-binding fragments thereof, which are derived from any of the amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"), and having weak or no detectable binding to a CD3 antigen. Several such exemplary antibodies that recognize CD3 are described in Tables 16, 18, 19, 22, and 23 herein.

Furthermore, the antibodies of the present invention may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antibodies and antigen-binding fragments that contain one or more germline mutations can be tested for one or more desired properties such as, improved binding specificity, weak or reduced binding or binding affinity, improved or enhanced pharmacokinetic properties, reduced immunogenicity, etc. Antibodies and antigen-binding fragments obtained in this general manner given the guidance of the present disclosure are encompassed within the present invention.

The present invention also includes anti-CD3 antibodies comprising variants of any of the HCVR, LCVR, and/or CDR amino acid sequences disclosed herein having one or more conservative substitutions. For example, the present invention includes anti-CD3 antibodies having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences set forth in Tables 16, 18, 19, 22, and 23 herein. The antibodies and bispecific antigen-binding molecules of the present invention comprise one or more amino acid substitutions, insertions and/or deletions in the framework and/or CDR regions of the heavy and light chain variable domains as compared to the corresponding germline sequences from which the individual antigen-binding domains were derived, while maintaining or improving the desired weak-to-no detectable binding to CD3 antigen. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein, i.e. the amino acid substitution maintains or improves the desired weak to no detectable binding or binding affinity in the case of anti-CD3 binding molecules. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443-1445. A "moderately conservative" replacement is any change having a nonnegative value in the PAM250 log-likelihood matrix.

The present invention also includes antigen-binding molecules comprising an antigen-binding domain with an HCVR and/or CDR amino acid sequence that is substantially identical to any of the HCVR and/or CDR amino acid sequences disclosed herein, while maintaining or improving the desired weak affinity to CD3 antigen. The term "substantial identity" or "substantially identical," when referring to an amino acid sequence means that two amino acid sequences, when optimally aligned, such as by the programs GAP or BESTFIT using default gap weights, share at least 95% sequence identity, even more preferably at least 98% or 99% sequence identity. Preferably, residue positions which are not identical differ by conservative amino acid substitutions. In cases where two or more amino acid sequences differ from each other by conservative substitutions, the percent sequence identity or degree of similarity may be adjusted upwards to correct for the conservative nature of the substitution. Means for making this adjustment are well-known to those of skill in the art. See, e.g., Pearson (1994) Methods Mol. Biol. 24: 307-331.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, GCG software contains programs such as Gap and Bestfit which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA using default or recommended parameters, a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215:403-410 and Altschul et al. (1997) Nucleic Acids Res. 25:3389-402.

Once obtained, antigen-binding domains that contain one or more germline mutations were tested for decreased binding or binding affinity utilizing one or more in vitro assays. Although antibodies that recognize a particular antigen are typically screened for their purpose by testing for high (i.e. strong) binding or binding affinity to the antigen, the antibodies of the present invention exhibit weak binding or no detectable binding. Bispecific antigen-binding molecules comprising one or more antigen-binding domains obtained in this general manner are also encompassed within the present invention and were found to be advantageous as avidity-driven tumor therapies.

Unexpected benefits, for example, improved pharmacokinetic properties and low toxicity to the patient may be realized from the methods described herein.

Binding Properties of the Antibodies

As used herein, the term "binding" in the context of the binding of an antibody, immunoglobulin, antibody-binding fragment, or Fc-containing protein to either, e.g., a predetermined antigen, such as a cell surface protein or fragment thereof, typically refers to an interaction or association between a minimum of two entities or molecular structures, such as an antibody-antigen interaction.

For instance, binding affinity typically corresponds to a $K_D$ value of about $10^{-7}$ M or less, such as about $10^{-8}$ M or less, such as about $10^{-9}$ M or less when determined by, for instance, surface plasmon resonance (SPR) technology in a BIAcore 3000 instrument using the antigen as the ligand and the antibody, Ig, antibody-binding fragment, or Fc-containing protein as the analyte (or antiligand). Cell-based binding strategies, such as fluorescent-activated cell sorting (FACS) binding assays, are also routinely used, and FACS data correlates well with other methods such as radioligand competition binding and SPR (Benedict, C A, *J Immunol Methods*. 1997, 201(2):223-31; Geuijen, C A, et al. *J Immunol Methods*. 2005, 302(1-2):68-77).

Accordingly, the antibody or antigen-binding protein of the invention binds to the predetermined antigen or cell surface molecule (receptor) having an affinity corresponding to a $K_D$ value that is at least ten-fold lower than its affinity for binding to a non-specific antigen (e.g., BSA, casein). According to the present invention, the affinity of an antibody corresponding to a $K_D$ value that is equal to or less than ten-fold lower than a non-specific antigen may be considered non-detectable binding, however such an antibody may be paired with a second antigen binding arm for the production of a bispecific antibody of the invention.

The term "$K_D$" (M) refers to the dissociation equilibrium constant of a particular antibody-antigen interaction, or the dissociation equilibrium constant of an antibody or antibody-binding fragment binding to an antigen. There is an inverse relationship between $K_D$ and binding affinity, therefore the smaller the $K_D$ value, the higher, i.e. stronger, the affinity. Thus, the terms "higher affinity" or "stronger affinity" relate to a higher ability to form an interaction and therefore a smaller $K_D$ value, and conversely the terms "lower affinity" or "weaker affinity" relate to a lower ability to form an interaction and therefore a larger $K_D$ value. In some circumstances, a higher binding affinity (or $K_D$) of a particular molecule (e.g. antibody) to its interactive partner molecule (e.g. antigen X) compared to the binding affinity of the molecule (e.g. antibody) to another interactive partner molecule (e.g. antigen Y) may be expressed as a binding ratio determined by dividing the larger $K_D$ value (lower, or weaker, affinity) by the smaller $K_D$ (higher, or stronger, affinity), for example expressed as 5-fold or 10-fold greater binding affinity, as the case may be.

The term "$k_d$" (sec−1 or 1/s) refers to the dissociation rate constant of a particular antibody-antigen interaction, or the dissociation rate constant of an antibody or antibody-binding fragment. Said value is also referred to as the $k_{off}$ value.

The term "$k_a$" (M−1×sec−1 or 1/M) refers to the association rate constant of a particular antibody-antigen interaction, or the association rate constant of an antibody or antibody-binding fragment.

The term "$K_A$" (M−1 or 1/M) refers to the association equilibrium constant of a particular antibody-antigen interaction, or the association equilibrium constant of an antibody or antibody-binding fragment. The association equilibrium constant is obtained by dividing the $k_a$ by the $k_d$.

The term "EC50" or "$EC_{50}$" refers to the half maximal effective concentration, which includes the concentration of an antibody which induces a response halfway between the baseline and maximum after a specified exposure time. The $EC_{50}$ essentially represents the concentration of an antibody where 50% of its maximal effect is observed. In certain embodiments, the $EC_{50}$ value equals the concentration of an antibody of the invention that gives half-maximal binding to cells expressing CD3 or tumor-associated antigen, as determined by e.g. a FACS binding assay. Thus, reduced or weaker binding is observed with an increased $EC_{50}$, or half maximal effective concentration value.

In one embodiment, decreased binding can be defined as an increased $EC_{50}$ antibody concentration which enables binding to the half-maximal amount of target cells.

In another embodiment, the $EC_{50}$ value represents the concentration of an antibody of the invention that elicits half-maximal depletion of target cells by T cell cytotoxic activity. Thus, increased cytotoxic activity (e.g. T cell-mediated tumor cell killing) is observed with a decreased $EC_{50}$, or half maximal effective concentration value.

Bispecific Antigen-Binding Molecules

The antibodies of the present invention may be mono-specific, bi-specific, or multispecific. Multispecific antibodies may be specific for different epitopes of one target polypeptide or may contain antigen-binding domains specific for more than one target polypeptide. See, e.g., Tutt et al., 1991, J. Immunol. 147:60-69; Kufer et al., 2004, Trends Biotechnol. 22:238-244. The anti-MUC16 monospecific antibodies or anti-MUC16/anti-CD3 bispecific antibodies of the present invention can be linked to or co-expressed with another functional molecule, e.g., another peptide or protein. For example, an antibody or fragment thereof can be functionally linked (e.g., by chemical coupling, genetic fusion, noncovalent association or otherwise) to one or more other molecular entities, such as another antibody or antibody fragment to produce a bi-specific or a multispecific antibody with a second or additional binding specificity.

Use of the expression "anti-CD3 antibody" or "anti-MUC16 antibody" herein is intended to include both mono-specific anti-CD3 or anti-MUC16 antibodies as well as bispecific antibodies comprising a CD3-binding arm and a MUC16-binding arm. Thus, the present invention includes bispecific antibodies wherein one arm of an immunoglobulin binds human CD3, and the other arm of the immunoglobulin is specific for human MUC16. The CD3-binding arm can comprise any of the HCVR/LCVR or CDR amino acid sequences as set forth in Tables 1, 16, 18, 19, 22, and 23 herein.

In certain embodiments, the CD3-binding arm binds to human CD3 and induces human T cell activation. In certain embodiments, the CD3-binding arm binds weakly to human CD3 and induces human T cell activation. In other embodiments, the CD3-binding arm binds weakly to human CD3 and induces tumor-associated antigen-expressing cell killing in the context of a bispecific or multispecific antibody. In other embodiments, the CD3-binding arm binds or associated weakly with human and cynomolgus (monkey) CD3, yet the binding interaction is not detectable by in vitro assays known in the art. The MUC16-binding arm can comprise any of the HCVR/LCVR or CDR amino acid sequences as set forth in Table 1 herein.

According to certain exemplary embodiments, the present invention includes bispecific antigen-binding molecules that specifically bind CD3 and MUC16. Such molecules may be referred to herein as, e.g., "anti-CD3/anti-MUC16," or "anti-CD3×MUC16" or "CD3×MUC16" bispecific molecules, or other similar terminology (e.g., anti-MUC16/anti-CD3). The invention provides bispecific antigen-binding molecules constructed with a first antigen-binding arm that binds MUC16 and a second antigen-binding arm that binds CD3. In some embodiments, the anti-CD3 arm comprises a heavy chain derived from IGHV3-9*01, IGHJ6*02, IGHD5-12*01. In other embodiments, the bispecific antigen-binding molecule activates human PBMC cells and/or induces cytotoxic activity on tumor antigen-expressing cell lines.

The term "MUC16," as used herein, refers to the human MUC16 protein unless specified as being from a non-human species (e.g., "mouse MUC16," "monkey MUC16," etc.). The human MUC16 protein has the amino acid sequence shown in SEQ ID NO:1899.

The aforementioned bispecific antigen-binding molecules that specifically bind CD3 and MUC16 may comprise an anti-CD3 antigen-binding molecule which binds to CD3 with a weak binding affinity such as exhibiting a $K_D$ of greater than about 40 nM, as measured by an in vitro affinity binding assay. The aforementioned bispecific antigen-binding molecules may comprise an anti-CD3 antigen-binding molecule which binds to CD3 and exhibits an EC50 of greater than about 100 nM, as measured by a FACS titration assay. The aforementioned bispecific antigen-binding molecules may comprise an anti-CD3 antigen-binding molecule which exhibits no measurable or observable binding to CD3, as measured by an in vitro affinity binding assay or a FACS titration assay, yet retains ability to activate human PBMC cells and/or induce cytotoxic activity on tumor antigen-expressing cell lines.

As used herein, the expression "antigen-binding molecule" means a protein, polypeptide or molecular complex comprising or consisting of at least one complementarity determining region (CDR) that alone, or in combination with one or more additional CDRs and/or framework regions (FRs), specifically binds to a particular antigen. In certain embodiments, an antigen-binding molecule is an antibody or a fragment of an antibody, as those terms are defined elsewhere herein.

As used herein, the expression "bispecific antigen-binding molecule" means a protein, polypeptide or molecular complex comprising at least a first antigen-binding domain and a second antigen-binding domain. Each antigen-binding domain within the bispecific antigen-binding molecule comprises at least one CDR that alone, or in combination with one or more additional CDRs and/or FRs, specifically binds to a particular antigen. In the context of the present invention, the first antigen-binding domain specifically binds a first antigen (e.g., CD3), and the second antigen-binding domain specifically binds a second, distinct antigen (e.g., MUC16).

In certain exemplary embodiments of the present invention, the bispecific antigen-binding molecule is a bispecific antibody. Each antigen-binding domain of a bispecific antibody comprises a heavy chain variable domain (HCVR) and a light chain variable domain (LCVR). In the context of a bispecific antigen-binding molecule comprising a first and a second antigen-binding domain (e.g., a bispecific antibody), the CDRs of the first antigen-binding domain may be designated with the prefix "A1" and the CDRs of the second antigen-binding domain may be designated with the prefix "A2". Thus, the CDRs of the first antigen-binding domain may be referred to herein as A1-HCDR1, A1-HCDR2, and A1-HCDR3; and the CDRs of the second antigen-binding domain may be referred to herein as A2-HCDR1, A2-HCDR2, and A2-HCDR3.

The first antigen-binding domain and the second antigen-binding domain may be directly or indirectly connected to one another to form a bispecific antigen-binding molecule of the present invention. Alternatively, the first antigen-binding domain and the second antigen-binding domain may each be connected to a separate multimerizing domain. The association of one multimerizing domain with another multimerizing domain facilitates the association between the two antigen-binding domains, thereby forming a bispecific antigen-binding molecule. As used herein, a "multimerizing domain" is any macromolecule, protein, polypeptide, peptide, or amino acid that has the ability to associate with a second multimerizing domain of the same or similar structure or constitution. For example, a multimerizing domain may be a polypeptide comprising an immunoglobulin $C_H3$ domain. A non-limiting example of a multimerizing component is an Fc portion of an immunoglobulin (comprising a $C_H2$-$C_H3$ domain), e.g., an Fc domain of an IgG selected from the isotypes IgG1, IgG2, IgG3, and IgG4, as well as any allotype within each isotype group.

Bispecific antigen-binding molecules of the present invention will typically comprise two multimerizing domains, e.g., two Fc domains that are each individually part of a separate antibody heavy chain. The first and second multimerizing domains may be of the same IgG isotype such as, e.g., IgG1/IgG1, IgG2/IgG2, IgG4/IgG4. Alternatively, the first and second multimerizing domains may be of different IgG isotypes such as, e.g., IgG1/IgG2, IgG1/IgG4, IgG2/IgG4, etc.

In certain embodiments, the multimerizing domain is an Fc fragment or an amino acid sequence of from 1 to about 200 amino acids in length containing at least one cysteine residue. In other embodiments, the multimerizing domain is a cysteine residue, or a short cysteine-containing peptide. Other multimerizing domains include peptides or polypeptides comprising or consisting of a leucine zipper, a helix-loop motif, or a coiled-coil motif.

Any bispecific antibody format or technology may be used to make the bispecific antigen-binding molecules of the present invention. For example, an antibody or fragment thereof having a first antigen binding specificity can be functionally linked (e.g., by chemical coupling, genetic fusion, noncovalent association or otherwise) to one or more other molecular entities, such as another antibody or antibody fragment having a second antigen-binding specificity to produce a bispecific antigen-binding molecule. Specific exemplary bispecific formats that can be used in the context of the present invention include, without limitation, e.g., scFv-based or diabody bispecific formats, IgG-scFv fusions, dual variable domain (DVD)-Ig, Quadroma, knobs-into-holes, common light chain (e.g., common light chain with knobs-into-holes, etc.), CrossMab, CrossFab, (SEED)body, leucine zipper, Duobody, IgG1/IgG2, dual acting Fab (DAF)-IgG, and Mab[2] bispecific formats (see, e.g., Klein et al. 2012, mAbs 4:6, 1-11, and references cited therein, for a review of the foregoing formats).

In the context of bispecific antigen-binding molecules of the present invention, the multimerizing domains, e.g., Fc domains, may comprise one or more amino acid changes (e.g., insertions, deletions or substitutions) as compared to the wild-type, naturally occurring version of the Fc domain. For example, the invention includes bispecific antigen-binding molecules comprising one or more modifications in the Fc domain that results in a modified Fc domain having a modified binding interaction (e.g., enhanced or diminished) between Fc and FcRn. In one embodiment, the bispecific antigen-binding molecule comprises a modification in a $C_H2$ or a $C_{H3}$ region, wherein the modification increases the affinity of the Fc domain to FcRn in an acidic environment (e.g., in an endosome where pH ranges from about 5.5 to about 6.0). Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256 (e.g., S/R/Q/E/D or T); or a modification at position 428 and/or 433 (e.g., L/R/S/P/Q or K) and/or 434 (e.g., H/F or Y); or a modification at position 250 and/or 428; or a modification at position 307 or 308

(e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P).

The present invention also includes bispecific antigen-binding molecules comprising a first $C_H3$ domain and a second Ig $C_H3$ domain, wherein the first and second Ig $C_H3$ domains differ from one another by at least one amino acid, and wherein at least one amino acid difference reduces binding of the bispecific antibody to Protein A as compared to a bi-specific antibody lacking the amino acid difference. In one embodiment, the first Ig $C_H3$ domain binds Protein A and the second Ig $C_H3$ domain contains a mutation that reduces or abolishes Protein A binding such as an H95R modification (by IMGT exon numbering; H435R by EU numbering). The second $C_H3$ may further comprise a Y96F modification (by IMGT; Y436F by EU). See, for example, U.S. Pat. No. 8,586,713. Further modifications that may be found within the second $C_H3$ include: D16E, L18M, N44S, K52N, V57M, and V82I (by IMGT; D356E, L358M, N384S, K392N, V397M, and V422I by EU) in the case of IgG1 antibodies; N44S, K52N, and V82I (IMGT; N384S, K392N, and V422I by EU) in the case of IgG2 antibodies; and Q15R, N44S, K52N, V57M, R69K, E79Q, and V82I (by IMGT; Q355R, N384S, K392N, V397M, R409K, E419Q, and V422I by EU) in the case of IgG4 antibodies.

In certain embodiments, the Fc domain may be chimeric, combining Fc sequences derived from more than one immunoglobulin isotype. For example, a chimeric Fc domain can comprise part or all of a $C_H2$ sequence derived from a human IgG1, human IgG2 or human IgG4 $C_H2$ region, and part or all of a $C_H3$ sequence derived from a human IgG1, human IgG2 or human IgG4. A chimeric Fc domain can also contain a chimeric hinge region. For example, a chimeric hinge may comprise an "upper hinge" sequence, derived from a human IgG1, a human IgG2 or a human IgG4 hinge region, combined with a "lower hinge" sequence, derived from a human IgG1, a human IgG2 or a human IgG4 hinge region. A particular example of a chimeric Fc domain that can be included in any of the antigen-binding molecules set forth herein comprises, from N- to C-terminus: [IgG4 CH1]-[IgG4 upper hinge]-[IgG2 lower hinge]-[IgG4 CH2]-[IgG4 CH3]. Another example of a chimeric Fc domain that can be included in any of the antigen-binding molecules set forth herein comprises, from N- to C-terminus: [IgG1 $C_H1$]-[IgG1 upper hinge]-[IgG2 lower hinge]-[IgG4 CH2]-[IgG1 CH3]. These and other examples of chimeric Fc domains that can be included in any of the antigen-binding molecules of the present invention are described in US Publication 2014/0243504, published Aug. 28, 2014, which is herein incorporated in its entirety. Chimeric Fc domains having these general structural arrangements, and variants thereof, can have altered Fc receptor binding, which in turn affects Fc effector function.

In certain embodiments, the invention provides an antibody heavy chain wherein the heavy chain constant region (CH) region comprises an amino acid sequence at least 95%, at least 96%, at least 97%, at least 98%, at least 99% identical to any one of SEQ ID NO: 1911, SEQ ID NO: 1912, SEQ ID NO: 1913, SEQ ID NO: 1914, SEQ ID NO: 1915, SEQ ID NO: 1916, SEQ ID NO: 1917, SEQ ID NO: 1918, SEQ ID NO: 1919 or SEQ ID NO: 1920. In some embodiments, the heavy chain constant region (CH) region comprises an amino acid sequence selected from the group consisting of SEQ ID NO: 1911, SEQ ID NO: 1912, SEQ ID NO: 1913, SEQ ID NO: 1914, SEQ ID NO: 1915, SEQ ID NO: 1916, SEQ ID NO: 1917, SEQ ID NO: 1918, SEQ ID NO: 1919 and SEQ ID NO: 1920.

In other embodiments, the invention provides an antibody heavy chain wherein the Fc domain comprises an amino acid sequence at least 95%, at least 96%, at least 97%, at least 98%, at least 99% identical to any one of SEQ ID NO: 1921, SEQ ID NO: 1922, SEQ ID NO: 1923 SEQ ID NO: 1924 SEQ ID NO: 1925, SEQ ID NO: 1926, SEQ ID NO: 1927, SEQ ID NO: 1928, SEQ ID NO: 1929 or SEQ ID NO: 1930. In some embodiments, the Fc domain comprises an amino acid sequence selected form the group consisting of SEQ ID NO: 1921, SEQ ID NO: 1922, SEQ ID NO: 1923 SEQ ID NO: 1924 SEQ ID NO: 1925, SEQ ID NO: 1926, SEQ ID NO: 1927, SEQ ID NO: 1928, SEQ ID NO: 1929 and SEQ ID NO: 1930.

Sequence Variants

The antibodies and bispecific antigen-binding molecules of the present invention may comprise one or more amino acid substitutions, insertions and/or deletions in the framework and/or CDR regions of the heavy and light chain variable domains as compared to the corresponding germline sequences from which the individual antigen-binding domains were derived. Such mutations can be readily ascertained by comparing the amino acid sequences disclosed herein to germline sequences available from, for example, public antibody sequence databases. The antigen-binding molecules of the present invention may comprise antigen-binding domains which are derived from any of the exemplary amino acid sequences disclosed herein, wherein one or more amino acids within one or more framework and/or CDR regions are mutated to the corresponding residue(s) of the germline sequence from which the antibody was derived, or to the corresponding residue(s) of another human germline sequence, or to a conservative amino acid substitution of the corresponding germline residue(s) (such sequence changes are referred to herein collectively as "germline mutations"). A person of ordinary skill in the art, starting with the heavy and light chain variable region sequences disclosed herein, can easily produce numerous antibodies and antigen-binding fragments which comprise one or more individual germline mutations or combinations thereof. In certain embodiments, all of the framework and/or CDR residues within the $V_H$ and/or $V_L$ domains are mutated back to the residues found in the original germline sequence from which the antigen-binding domain was originally derived. In other embodiments, only certain residues are mutated back to the original germline sequence, e.g., only the mutated residues found within the first 8 amino acids of FR1 or within the last 8 amino acids of FR4, or only the mutated residues found within CDR1, CDR2 or CDR3. In other embodiments, one or more of the framework and/or CDR residue(s) are mutated to the corresponding residue(s) of a different germline sequence (i.e., a germline sequence that is different from the germline sequence from which the antigen-binding domain was originally derived). Furthermore, the antigen-binding domains may contain any combination of two or more germline mutations within the framework and/or CDR regions, e.g., wherein certain individual residues are mutated to the corresponding residue of a particular germline sequence while certain other residues that differ from the original germline sequence are maintained or are mutated to the corresponding residue of a different germline sequence. Once obtained, antigen-binding domains that contain one or more germline mutations can be easily tested for one or more desired property such as, improved binding specificity, increased binding or binding affinity, improved or enhanced antagonistic or agonistic biological properties (as the case may be), reduced immunogenicity, etc. Bispecific antigen-binding molecules comprising one or more antigen-binding domains obtained in this general manner are encompassed within the present invention.

The present invention also includes antigen-binding molecules wherein one or both antigen-binding domains comprise variants of any of the HCVR, LCVR, and/or CDR amino acid sequences disclosed herein having one or more conservative substitutions. For example, the present invention includes antigen-binding molecules comprising an antigen-binding domain having HCVR, LCVR, and/or CDR amino acid sequences with, e.g., 10 or fewer, 8 or fewer, 6 or fewer, 4 or fewer, etc. conservative amino acid substitutions relative to any of the HCVR, LCVR, and/or CDR amino acid sequences disclosed herein. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. Examples of groups of amino acids that have side chains with similar chemical properties include (1) aliphatic side chains: glycine, alanine, valine, leucine and isoleucine; (2) aliphatic-hydroxyl side chains: serine and threonine; (3) amide-containing side chains: asparagine and glutamine; (4) aromatic side chains: phenylalanine, tyrosine, and tryptophan; (5) basic side chains: lysine, arginine, and histidine; (6) acidic side chains: aspartate and glutamate, and (7) sulfur-containing side chains are cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443-1445, herein incorporated by reference. A "moderately conservative" replacement is any change having a nonnegative value in the PAM250 log-likelihood matrix.

The present invention also includes antigen-binding molecules comprising an antigen-binding domain with an HCVR, LCVR, and/or CDR amino acid sequence that is substantially identical to any of the HCVR, LCVR, and/or CDR amino acid sequences disclosed herein. The term "substantial identity" or "substantially identical," when referring to an amino acid sequence means that two amino acid sequences, when optimally aligned, such as by the programs GAP or BESTFIT using default gap weights, share at least 95% sequence identity, even more preferably at least 98% or 99% sequence identity. Preferably, residue positions which are not identical differ by conservative amino acid substitutions. In cases where two or more amino acid sequences differ from each other by conservative substitutions, the percent sequence identity or degree of similarity may be adjusted upwards to correct for the conservative nature of the substitution. Means for making this adjustment are well-known to those of skill in the art. See, e.g., Pearson (1994) Methods Mol. Biol. 24: 307-331, herein incorporated by reference.

Sequence similarity for polypeptides, which is also referred to as sequence identity, is typically measured using sequence analysis software. Protein analysis software matches similar sequences using measures of similarity assigned to various substitutions, deletions and other modifications, including conservative amino acid substitutions. For instance, GCG software contains programs such as Gap and Bestfit which can be used with default parameters to determine sequence homology or sequence identity between closely related polypeptides, such as homologous polypeptides from different species of organisms or between a wild type protein and a mutein thereof. See, e.g., GCG Version 6.1. Polypeptide sequences also can be compared using FASTA using default or recommended parameters, a program in GCG Version 6.1. FASTA (e.g., FASTA2 and FASTA3) provides alignments and percent sequence identity of the regions of the best overlap between the query and search sequences (Pearson (2000) supra). Another preferred algorithm when comparing a sequence of the invention to a database containing a large number of sequences from different organisms is the computer program BLAST, especially BLASTP or TBLASTN, using default parameters. See, e.g., Altschul et al. (1990) J. Mol. Biol. 215:403-410 and Altschul et al. (1997) Nucleic Acids Res. 25:3389-402, each herein incorporated by reference.

pH-Dependent Binding

The present invention includes anti-MUC16 antibodies, and anti-CD3/anti-MUC16 bispecific antigen-binding molecules, with pH-dependent binding characteristics. For example, an anti-MUC16 antibody of the present invention may exhibit reduced binding to MUC16 at acidic pH as compared to neutral pH. Alternatively, anti-MUC16 antibodies of the invention may exhibit enhanced binding to MUC16 at acidic pH as compared to neutral pH. The expression "acidic pH" includes pH values less than about 6.2, e.g., about 6.0, 5.95, 5.9, 5.85, 5.8, 5.75, 5.7, 5.65, 5.6, 5.55, 5.5, 5.45, 5.4, 5.35, 5.3, 5.25, 5.2, 5.15, 5.1, 5.05, 5.0, or less. As used herein, the expression "neutral pH" means a pH of about 7.0 to about 7.4. The expression "neutral pH" includes pH values of about 7.0, 7.05, 7.1, 7.15, 7.2, 7.25, 7.3, 7.35, and 7.4.

In certain instances, "reduced binding . . . at acidic pH as compared to neutral pH" is expressed in terms of a ratio of the $K_D$ value of the antibody binding to its antigen at acidic pH to the $K_D$ value of the antibody binding to its antigen at neutral pH (or vice versa). For example, an antibody or antigen-binding fragment thereof may be regarded as exhibiting "reduced binding to MUC16 at acidic pH as compared to neutral pH" for purposes of the present invention if the antibody or antigen-binding fragment thereof exhibits an acidic/neutral $K_D$ ratio of about 3.0 or greater. In certain exemplary embodiments, the acidic/neutral $K_D$ ratio for an antibody or antigen-binding fragment of the present invention can be about 3.0, 3.5, 4.0, 4.5, 5.0, 5.5, 6.0, 6.5, 7.0, 7.5, 8.0, 8.5, 9.0, 9.5, 10.0, 10.5, 11.0, 11.5, 12.0, 12.5, 13.0, 13.5, 14.0, 14.5, 15.0, 20.0. 25.0, 30.0, 40.0, 50.0, 60.0, 70.0, 100.0 or greater.

Antibodies with pH-dependent binding characteristics may be obtained, e.g., by screening a population of antibodies for reduced (or enhanced) binding to a particular antigen at acidic pH as compared to neutral pH. Additionally, modifications of the antigen-binding domain at the amino acid level may yield antibodies with pH-dependent characteristics. For example, by substituting one or more amino acids of an antigen-binding domain (e.g., within a CDR) with a histidine residue, an antibody with reduced antigen-binding at acidic pH relative to neutral pH may be obtained.

Antibodies Comprising Fc Variants

According to certain embodiments of the present invention, anti-MUC16 antibodies, and anti-CD3/anti-MUC16 bispecific antigen-binding molecules, are provided comprising an Fc domain comprising one or more mutations which enhance or diminish antibody binding to the FcRn receptor, e.g., at acidic pH as compared to neutral pH. For example, the present invention includes antibodies comprising a mutation in the $C_H2$ or a $C_H3$ region of the Fc domain, wherein the mutation(s) increases the affinity of the Fc domain to FcRn in an acidic environment (e.g., in an endosome where pH ranges from about 5.5 to about 6.0). Such mutations may result in an increase in serum half-life of the antibody when administered to an animal. Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256 (e.g., S/R/Q/E/D or T); or a modification at position 428 and/or 433 (e.g., H/L/R/S/P/Q or K) and/or 434 (e.g., H/F or Y); or a modification at position 250 and/or 428; or a modification at position 307 or 308 (e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P).

For example, the present invention includes anti-MUC16 antibodies, and anti-CD3/anti-MUC16 bispecific antigen-binding molecules, comprising an Fc domain comprising one or more pairs or groups of mutations selected from the group consisting of: 250Q and 248L (e.g., T250Q and M248L); 252Y, 254T and 256E (e.g., M252Y, S254T and T256E); 428L and 434S (e.g., M428L and N434S); and 433K and 434F (e.g., H433K and N434F). All possible combinations of the foregoing Fc domain mutations, and other mutations within the antibody variable domains disclosed herein, are contemplated within the scope of the present invention.

Biological Characteristics of the Antibodies and Bispecific Antigen-Binding Molecules The present invention includes antibodies and antigen-binding fragments thereof that bind human MUC16 with high affinity (e.g., sub-nanomolar $K_D$ values).

According to certain embodiments, the present invention includes antibodies and antigen-binding fragments of antibodies that bind human MUC16 (e.g., at 25° C.) with a $K_D$ of less than about 60 nM as measured by surface plasmon resonance, e.g., using an assay format as defined in Example 4 herein. In certain embodiments, the antibodies or antigen-binding fragments of the present invention bind MUC16 with a $K_D$ of less than about 60 nM, less than about 40 nM, less than about 20 nM, less than about 10 nM, less than about 8 nM, less than about 7 nM, less than about 6 nM, less than about 5 nM, less than about 4 nM, less than about 3 nM, less than about 2 nM, less than about 1 nM, less than about 800 pM, less than about 700 pM, less than about 500 pM, less than about 400 pM, or less than about 300 pM, as measured by surface plasmon resonance, e.g., using an assay format as defined in Example 4 herein (e.g., mAb-capture or antigen-capture format), or a substantially similar assay. The present invention includes bispecific antigen-binding molecules (e.g., bispecific antibodies which bind MUC16 with a $K_D$ of less than about 7 nM, as measured by surface plasmon resonance, e.g., using an assay format as defined in Example 4 herein (e.g., mAb-capture or antigen-capture format), or a substantially similar assay.

The present invention also includes antibodies and antigen-binding fragments thereof that bind MUC16 with a dissociative half-life (t ½) of greater than about 10 minutes or greater than about 125 minutes as measured by surface plasmon resonance at 25° C., e.g., using an assay format as defined in Example 4 herein, or a substantially similar assay. In certain embodiments, the antibodies or antigen-binding fragments of the present invention bind MUC16 with a t ½ of greater than about 10 minutes, greater than about 20 minutes, greater than about 30 minutes, greater than about 40 minutes, greater than about 50 minutes, greater than about 60 minutes, greater than about 70 minutes, greater than about 80 minutes, greater than about 90 minutes, greater than about 100 minutes, greater than about 110 minutes, or greater than about 120 minutes, as measured by surface plasmon resonance at 25° C., e.g., using an assay format as defined in Example 4 herein (e.g., mAb-capture or antigen-capture format), or a substantially similar assay. The present invention includes bispecific antigen-binding molecules (e.g., bispecific antibodies which bind MUC16 with a of greater than about 10 minutes or greater than about 20 minutes as measured by surface plasmon resonance at 25° C., e.g., using an assay format as defined in Example 4 herein, or a substantially similar assay.

The present invention also includes antibodies and antigen-binding fragments thereof which bind specifically to human cell lines which express endogenous MUC16 (e.g., OVCAR-3), as determined by an electrochemoluminescence-based detection assay as set forth in Example 2 or a substantially similar assay.

The present invention also includes anti-CD3/anti-MUC16 bispecific antigen-binding molecules which exhibit one or more characteristics selected from the group consisting of: (a) inhibiting tumor growth in immunocompromised mice bearing human ovarian cancer xenografts; and (b); suppressing tumor growth of established tumors in immunocompromised mice bearing human ovarian cancer xenografts (see, e.g., Example 8).

The present invention includes antibodies and antigen-binding fragments thereof that bind human CD3 with high affinity. The present invention also includes antibodies and antigen-binding fragments thereof that bind human CD3 with medium or low affinity, depending on the therapeutic context and particular targeting properties that are desired. In some cases, the low affinity includes antibodies that bind CD3 with a $K_D$ or $EC_{50}$ (e.g., as measured in a surface plasmon resonance assay) of greater than about 300 nM, greater than 500 nM or greater than 1 µM. The present invention also includes antibodies and antigen-binding fragments thereof that bind human CD3 with no measureable affinity. For example, in the context of a bispecific antigen-binding molecule, wherein one arm binds CD3 and another arm binds a target antigen (e.g., MUC16), it may be desirable for the target antigen-binding arm to bind the target antigen with high affinity while the anti-CD3 arm binds CD3 with only moderate or low affinity or no affinity. In this manner, preferential targeting of the antigen-binding molecule to cells expressing the target antigen may be achieved while avoiding general/untargeted CD3 binding and the consequent adverse side effects associated therewith.

The present invention includes bispecific antigen-binding molecules (e.g., bispecific antibodies) which are capable of simultaneously binding to human CD3 and a human MUC16. The binding arm that interacts with cells that express CD3 may have weak to no detectable binding as measured in a suitable in vitro binding assay. The extent to which a bispecific antigen-binding molecule binds cells that express CD3 and/or MUC16 can be assessed by fluorescence activated cell sorting (FACS), as illustrated in Example 5 herein.

For example, the present invention includes antibodies, antigen-binding fragments, and bispecific antibodies thereof which specifically bind human T-cell lines which express CD3 but do not express MUC16 (e.g., Jurkat), primate T-cells (e.g., cynomolgus peripheral blood mononuclear cells [PBMCs]), and/or MUC16-expressing cells.

The present invention includes antibodies, antigen-binding fragments, and bispecific antibodies thereof that bind human CD3 with weak (i.e. low) or even no detectable binding or binding affinity.

The present invention includes antibodies, antigen-binding fragments, and bispecific antibodies thereof that bind monkey (i.e. cynomolgus) CD3 with weak (i.e. low) or even no detectable binding or binding affinity.

The present invention includes antibodies, antigen-binding fragments, and bispecific antibodies thereof that bind human CD3 and induce T cell activation.

The present invention includes anti-CD3/anti-MUC16 bispecific antigen-binding molecules which are capable of depleting tumor antigen-expressing cells in a subject (see, e.g., Example 8, in a bioluminescent imaging assay, or a substantially similar assay). For example, according to certain embodiments, anti-CD3/anti-MUC16 bispecific antigen-binding molecules are provided, wherein a single administration of 10 μg of the bispecific antigen-binding molecule to a subject causes a reduction in the number of MUC16-expressing cells in the subject (e.g., tumor growth in the subject is suppressed or inhibited). Unless otherwise indicated, bioluminescent radiance refers to [p/s/cm2$^2$/sr].

The present invention also includes anti-MUC16 antibody drug conjugates which inhibit tumor growth in in vivo MUC16 positive ovarian cancer xenograft models (see, e.g., Example 10, in a bioluminescent imaging assay, or a substantially similar assay). In certain embodiments, anti-MUC16 antibody drug conjugates with Compound 7 are provided wherein four once weekly doses administered at a dose of 85 μg/kg inhibit intraperitoneal OVCAR3/luc tumor growth in in vivo. In certain embodiments, anti-MUC16 antibody drug conjugates with Compound 7 are provided wherein four once weekly doses administered at a dose of 85 μg/kg inhibit subcutaneous OVCAR3/luc tumor growth in in vivo. In certain embodiments, anti-MUC16 antibody drug conjugates with Compound 10 are provided wherein a single dose at a dose of 85 μg/kg, 170 μg/kg, or 340 μg/kg inhibit intraperitoneal OVCAR3/luc tumor growth in in vivo. Unless otherwise indicated, bioluminescent radiance refers to [p/s/cm2$^2$/sr].

Figure 2:
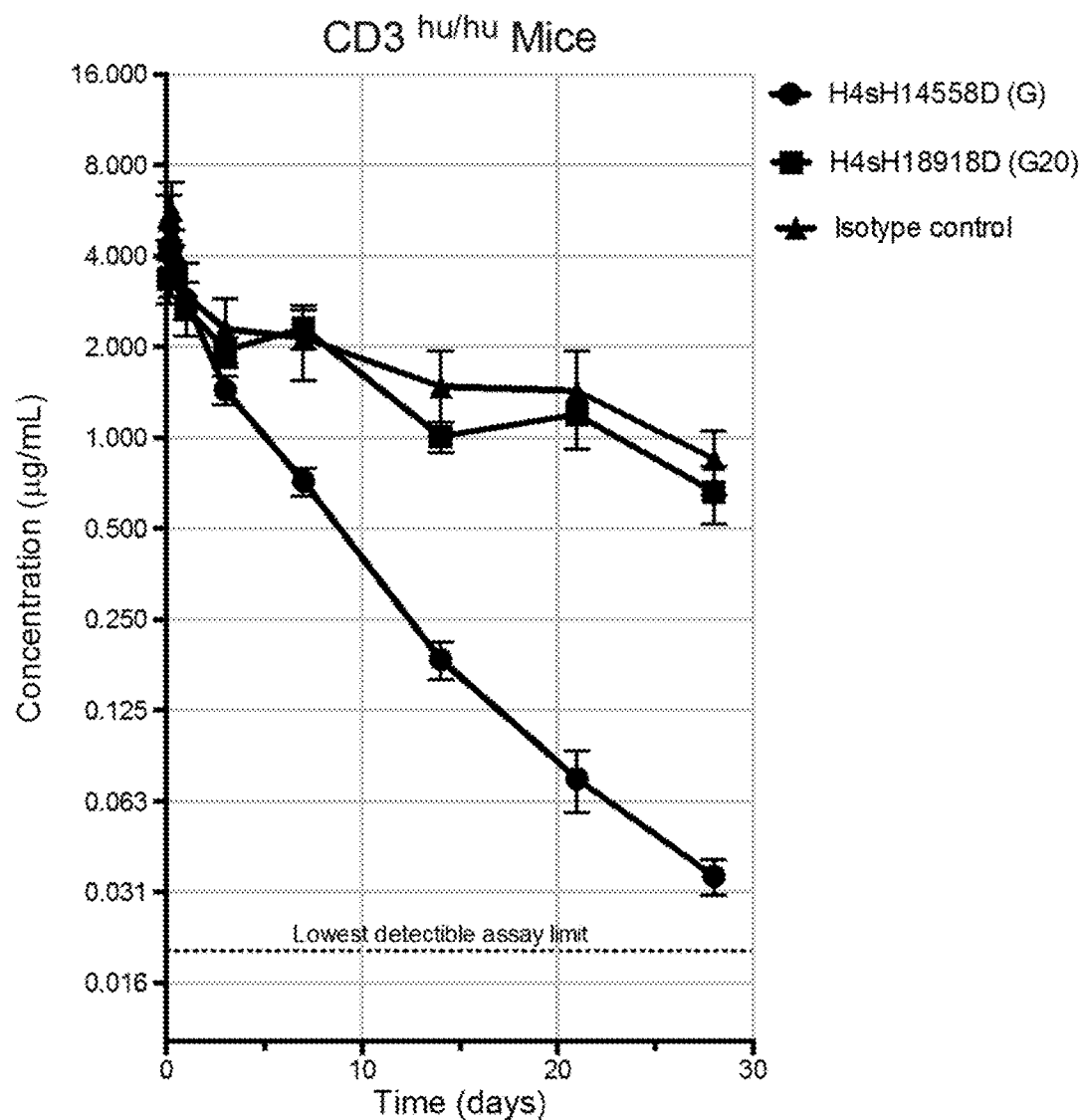
Figure 3:
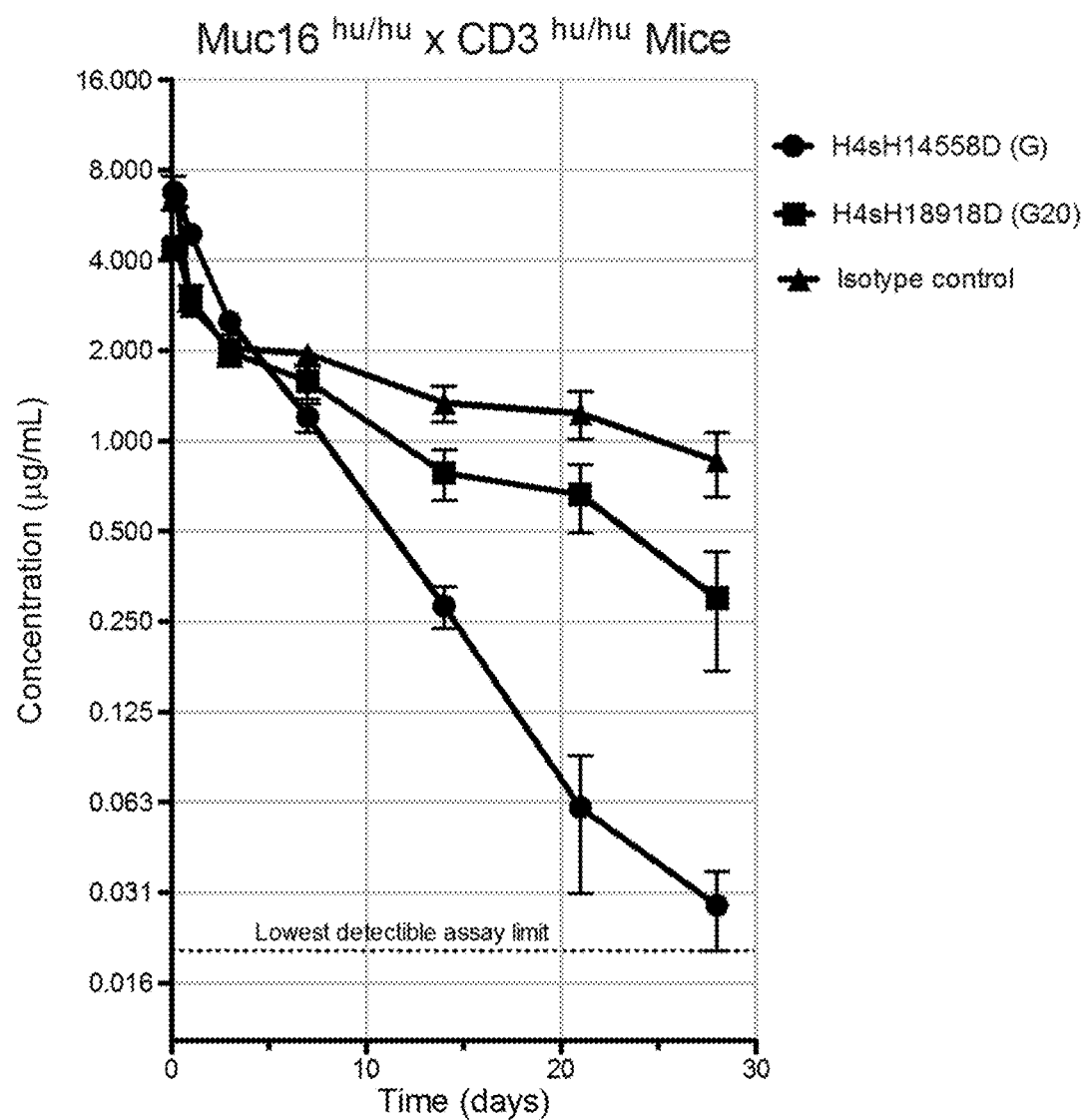

The present invention also includes anti-CD3/anti-MUC16 bispecific antigen-binding molecules which exhibit pharmacokinetic profiles in humanized MUC16×CD3 mice (mice homozygous for human MUC16 and CD3 expression, MUC16$^{hu/hu}$×CD3$^{hu/hu}$), CD3 humanized mice (mice homozygous for human CD3 expression, CD3$^{hu/hu}$) and strain-matched (75% C57BL, 25%129Sv) wild-type (WT) mice, as described in Example 7 and shown in FIGS. 1, 2, and 3.

Epitope Mapping and Related Technologies

The epitope on CD3 and/or MUC16 to which the antigen-binding molecules of the present invention bind may consist of a single contiguous sequence of 3 or more (e.g., 3, 4, 5, 6, 7, 8, 9, 10, 11, 12, 13, 14, 15, 16, 17, 18, 19, 20 or more) amino acids of a CD3 or MUC16 protein. Alternatively, the epitope may consist of a plurality of non-contiguous amino acids (or amino acid sequences) of CD3 or MUC16. The antibodies of the invention may interact with amino acids contained within a single CD3 chain (e.g., CD3-epsilon, CD3-delta or CD3-gamma), or may interact with amino acids on two or more different CD3 chains. The term "epitope," as used herein, refers to an antigenic determinant that interacts with a specific antigen binding site in the variable region of an antibody molecule known as a paratope. A single antigen may have more than one epitope. Thus, different antibodies may bind to different areas on an antigen and may have different biological effects. Epitopes may be either conformational or linear. A conformational epitope is produced by spatially juxtaposed amino acids from different segments of the linear polypeptide chain. A linear epitope is one produced by adjacent amino acid residues in a polypeptide chain. In certain circumstances, an epitope may include moieties of saccharides, phosphoryl groups, or sulfonyl groups on the antigen.

Various techniques known to persons of ordinary skill in the art can be used to determine whether an antigen-binding domain of an antibody "interacts with one or more amino acids" within a polypeptide or protein. Exemplary techniques include, e.g., routine cross-blocking assay such as that described Antibodies, Harlow and Lane (Cold Spring Harbor Press, Cold Spring Harb., N.Y.), alanine scanning mutational analysis, peptide blots analysis (Reineke, 2004, Methods Mol Biol 248:443-463), and peptide cleavage analysis. In addition, methods such as epitope excision, epitope extraction and chemical modification of antigens can be employed (Tomer, 2000, Protein Science 9:487-496). Another method that can be used to identify the amino acids within a polypeptide with which an antigen-binding domain of an antibody interacts is hydrogen/deuterium exchange detected by mass spectrometry. In general terms, the hydrogen/deuterium exchange method involves deuterium-labeling the protein of interest, followed by binding the antibody to the deuterium-labeled protein. Next, the protein/antibody complex is transferred to water to allow hydrogen-deuterium exchange to occur at all residues except for the residues protected by the antibody (which remain deuterium-labeled). After dissociation of the antibody, the target protein is subjected to protease cleavage and mass spectrometry analysis, thereby revealing the deuterium-labeled residues which correspond to the specific amino acids with which the antibody interacts. See, e.g., Ehring (1999) *Analytical Biochemistry* 267(2):252-259; Engen and Smith (2001) *Anal. Chem.* 73:256A-265A. X-ray crystallography of the antigen/antibody complex may also be used for epitope mapping purposes.

The present invention further includes anti-MUC16 antibodies that bind to the same epitope as any of the specific exemplary antibodies described herein (e.g. antibodies comprising any of the amino acid sequences as set forth in Table 1 herein). Likewise, the present invention also includes anti-MUC16 antibodies that compete for binding to MUC16 with any of the specific exemplary antibodies described herein (e.g. antibodies comprising any of the amino acid sequences as set forth in Table 1 herein).

The present invention also includes bispecific antigen-binding molecules comprising a first antigen-binding domain that specifically binds human CD3 and/or cynomolgus CD3 with low or no detectable binding or binding affinity, and a second antigen binding domain that specifically binds human MUC16, wherein the first antigen-binding domain binds to the same epitope on CD3 as any of the specific exemplary CD3-specific antigen-binding domains described herein, and/or wherein the second antigen-binding domain binds to the same epitope on MUC16 as any of the specific exemplary MUC16-specific antigen-binding domains described herein.

Likewise, the present invention also includes bispecific antigen-binding molecules comprising a first antigen-binding domain that specifically binds human CD3, and a second antigen binding domain that specifically binds human MUC16, wherein the first antigen-binding domain competes for binding to CD3 with any of the specific exemplary CD3-specific antigen-binding domains described herein, and/or wherein the second antigen-binding domain competes for binding to MUC16 with any of the specific exemplary MUC16-specific antigen-binding domains described herein.

One can easily determine whether a particular antigen-binding molecule (e.g., antibody) or antigen-binding domain thereof binds to the same epitope as, or competes for binding with, a reference antigen-binding molecule of the present invention by using routine methods known in the art. For example, to determine if a test antibody binds to the same epitope on MUC16 (or CD3) as a reference bispecific antigen-binding molecule of the present invention, the reference bispecific molecule is first allowed to bind to a MUC16 protein (or CD3 protein). Next, the ability of a test antibody to bind to the MUC16 (or CD3) molecule is assessed. If the test antibody is able to bind to MUC16 (or CD3) following saturation binding with the reference bispecific antigen-binding molecule, it can be concluded that the test antibody binds to a different epitope of MUC16 (or CD3) than the reference bispecific antigen-binding molecule. On the other hand, if the test antibody is not able to bind to the MUC16 (or CD3) molecule following saturation binding with the reference bispecific antigen-binding molecule, then the test antibody may bind to the same epitope of MUC16 (or CD3) as the epitope bound by the reference bispecific antigen-binding molecule of the invention. Additional routine experimentation (e.g., peptide mutation and binding analyses) can then be carried out to confirm whether the observed lack of binding of the test antibody is in fact due to binding to the same epitope as the reference bispecific antigen-binding molecule or if steric blocking (or another phenomenon) is responsible for the lack of observed binding. Experiments of this sort can be performed using ELISA, RIA, Biacore, flow cytometry or any other quantitative or qualitative antibody-binding assay available in the art. In accordance with certain embodiments of the present invention, two antigen-binding proteins bind to the same (or overlapping) epitope if, e.g., a 1-, 5-, 10-, 20- or 100-fold excess of one antigen-binding protein inhibits binding of the other by at least 50% but preferably 75%, 90% or even 99% as measured in a competitive binding assay (see, e.g., Junghans et al., Cancer Res. 1990:50:1495-1502). Alternatively, two antigen-binding proteins are deemed to bind to the same epitope if essentially all amino acid mutations in the antigen that reduce or eliminate binding of one antigen-binding protein reduce or eliminate binding of the other. Two antigen-binding proteins are deemed to have "overlapping epitopes" if only a subset of the amino acid mutations that reduce or eliminate binding of one antigen-binding protein reduce or eliminate binding of the other.

To determine if an antibody or antigen-binding domain thereof competes for binding with a reference antigen-binding molecule, the above-described binding methodology is performed in two orientations: In a first orientation, the reference antigen-binding molecule is allowed to bind to a MUC16 protein (or CD3 protein) under saturating conditions followed by assessment of binding of the test antibody to the MUC16 (or CD3) molecule. In a second orientation, the test antibody is allowed to bind to a MUC16 (or CD3) molecule under saturating conditions followed by assessment of binding of the reference antigen-binding molecule to the MUC16 (or CD3) molecule. If, in both orientations, only the first (saturating) antigen-binding molecule is capable of binding to the MUC16 (or CD3) molecule, then it is concluded that the test antibody and the reference antigen-binding molecule compete for binding to MUC16 (or CD3). As will be appreciated by a person of ordinary skill in the art, an antibody that competes for binding with a reference antigen-binding molecule may not necessarily bind to the same epitope as the reference antibody, but may sterically block binding of the reference antibody by binding an overlapping or adjacent epitope.

Preparation of Antigen-Binding Domains and Construction of Bispecific Molecules

Antigen-binding domains specific for particular antigens can be prepared by any antibody generating technology known in the art. Once obtained, two different antigen-binding domains, specific for two different antigens (e.g., CD3 and MUC16), can be appropriately arranged relative to one another to produce a bispecific antigen-binding molecule of the present invention using routine methods. (A discussion of exemplary bispecific antibody formats that can be used to construct the bispecific antigen-binding molecules of the present invention is provided elsewhere herein). In certain embodiments, one or more of the individual components (e.g., heavy and light chains) of the multispecific antigen-binding molecules of the invention are derived from chimeric, humanized or fully human antibodies. Methods for making such antibodies are well known in the art. For example, one or more of the heavy and/or light chains of the bispecific antigen-binding molecules of the present invention can be prepared using VELOCIMMUNE™ technology. Using VELOCIMMUNE™ technology (or any other human antibody generating technology), high affinity chimeric antibodies to a particular antigen (e.g., CD3 or MUC16) are initially isolated having a human variable region and a mouse constant region. The antibodies are characterized and selected for desirable characteristics, including affinity, selectivity, epitope, etc. The mouse constant regions are replaced with a desired human constant region to generate fully human heavy and/or light chains that can be incorporated into the bispecific antigen-binding molecules of the present invention.

Genetically engineered animals may be used to make human bispecific antigen-binding molecules. For example, a genetically modified mouse can be used which is incapable of rearranging and expressing an endogenous mouse immunoglobulin light chain variable sequence, wherein the mouse expresses only one or two human light chain variable domains encoded by human immunoglobulin sequences operably linked to the mouse kappa constant gene at the endogenous mouse kappa locus. Such genetically modified mice can be used to produce fully human bispecific antigen-binding molecules comprising two different heavy chains that associate with an identical light chain that comprises a variable domain derived from one of two different human light chain variable region gene segments. (See, e.g., US 2011/0195454). Fully human refers to an antibody, or antigen-binding fragment or immunoglobulin domain thereof, comprising an amino acid sequence encoded by a DNA derived from a human sequence over the entire length of each polypeptide of the antibody or antigen-binding fragment or immunoglobulin domain thereof. In some instances, the fully human sequence is derived from a protein endogenous to a human. In other instances, the fully human protein or protein sequence comprises a chimeric sequence wherein each component sequence is derived from human sequence.

While not being bound by any one theory, chimeric proteins or chimeric sequences are generally designed to minimize the creation of immunogenic epitopes in the junctions of component sequences, e.g. compared to any wild-type human immunoglobulin regions or domains.

Bioequivalents

The present invention encompasses antigen-binding molecules having amino acid sequences that vary from those of the exemplary molecules disclosed herein but that retain the ability to bind CD3 and/or MUC16. Such variant molecules may comprise one or more additions, deletions, or substitutions of amino acids when compared to parent sequence, but exhibit biological activity that is essentially equivalent to that of the described bispecific antigen-binding molecules.

The present invention includes antigen-binding molecules that are bioequivalent to any of the exemplary antigen-binding molecules set forth herein. Two antigen-binding proteins, or antibodies, are considered bioequivalent if, for example, they are pharmaceutical equivalents or pharmaceutical alternatives whose rate and extent of absorption do not show a significant difference when administered at the same molar dose under similar experimental conditions, either single does or multiple dose. Some antigen-binding proteins will be considered equivalents or pharmaceutical alternatives if they are equivalent in the extent of their absorption but not in their rate of absorption and yet may be considered bioequivalent because such differences in the rate of absorption are intentional and are reflected in the labeling, are not essential to the attainment of effective body drug concentrations on, e.g., chronic use, and are considered medically insignificant for the particular drug product studied.

In one embodiment, two antigen-binding proteins are bioequivalent if there are no clinically meaningful differences in their safety, purity, and potency.

In one embodiment, two antigen-binding proteins are bioequivalent if a patient can be switched one or more times between the reference product and the biological product without an expected increase in the risk of adverse effects, including a clinically significant change in immunogenicity, or diminished effectiveness, as compared to continued therapy without such switching.

In one embodiment, two antigen-binding proteins are bioequivalent if they both act by a common mechanism or mechanisms of action for the condition or conditions of use, to the extent that such mechanisms are known.

Bioequivalence may be demonstrated by in vivo and in vitro methods. Bioequivalence measures include, e.g., (a) an in vivo test in humans or other mammals, in which the concentration of the antibody or its metabolites is measured in blood, plasma, serum, or other biological fluid as a function of time; (b) an in vitro test that has been correlated with and is reasonably predictive of human in vivo bioavailability data; (c) an in vivo test in humans or other mammals in which the appropriate acute pharmacological effect of the antibody (or its target) is measured as a function of time; and (d) in a well-controlled clinical trial that establishes safety, efficacy, or bioavailability or bioequivalence of an antigen-binding protein.

Bioequivalent variants of the exemplary bispecific antigen-binding molecules set forth herein may be constructed by, for example, making various substitutions of residues or sequences or deleting terminal or internal residues or sequences not needed for biological activity. For example, cysteine residues not essential for biological activity can be deleted or replaced with other amino acids to prevent formation of unnecessary or incorrect intramolecular disulfide bridges upon renaturation. In other contexts, bioequivalent antigen-binding proteins may include variants of the exemplary bispecific antigen-binding molecules set forth herein comprising amino acid changes which modify the glycosylation characteristics of the molecules, e.g., mutations which eliminate or remove glycosylation.

Species Selectivity and Species Cross-Reactivity

According to certain embodiments of the invention, antigen-binding molecules are provided which bind to human CD3 but not to CD3 from other species. Also provided are antigen-binding molecules which bind to human MUC16. The present invention also includes antigen-binding molecules that bind to human CD3 and to CD3 from one or more non-human species; and/or antigen-binding molecules that bind to human MUC16.

According to certain exemplary embodiments of the invention, antigen-binding molecules are provided which bind to human CD3 and/or human MUC16 and may bind or not bind, as the case may be, to one or more of mouse, rat, guinea pig, hamster, gerbil, pig, cat, dog, rabbit, goat, sheep, cow, horse, camel, cynomolgus, marmoset, rhesus or chimpanzee CD3 and/or MUC16. For example, in a particular exemplary embodiment of the present invention bispecific antigen-binding molecules are provided comprising a first antigen-binding domain that binds human CD3 and cynomolgus CD3, and a second antigen-binding domain that specifically binds human MUC16.

Antibody-Drug Conjugates (ADCs)

The present invention provides antibody-drug conjugates (ADCs) comprising an anti-MUC16 antibody or antigen-binding fragment thereof conjugated to a therapeutic moiety such as a cytotoxic agent, a chemotherapeutic drug, immunosuppressant or a radioisotope. In general terms, the ADCs comprise: $A\text{-}[L\text{-}P]_y$, in which A is an antigen-binding molecule, e.g. an anti-MUC16 antibody, or a fragment thereof (e.g., a fragment comprising at least a HCDR3 selected from any of the HCDR3 amino acid sequences listed in Table 1), L is a linker, P is the payload or therapeutic moiety (e.g., cytotoxic agent), and y is an integer from 1 to 30. In various embodiments, the ADC comprises an anti-MUC16 antibody or antigen-binding fragment thereof that comprises the CDRs of a HCVR and a LCVR having the amino acid sequences of the SEQ ID NOs (e.g., SEQ ID NOs: 2 and 10) set forth in Table 1, or specific HCVR/LCVR pairs (e.g., SEQ ID NOs: 2/10). In some cases, the anti-MUC16 antibody or fragment comprises CDRs with the amino acid sequences of the SEQ ID NOs (e.g., SEQ ID NOs: 4-6-8-12-14-16) set forth in Table 1. In some cases, the anti-MUC16 antibody or fragment comprises a HCVR and a LCVR having the amino acid sequences of the SEQ ID NOs (e.g., SEQ ID NOs: 2 and 10) set forth in Table 1, or specific amino acid sequence pairs (e.g., SEQ ID NOs: 2/10). In some cases, the anti-MUC16 antibody is an antibody or antigen-binding fragment that binds human MUC16 within one or more of five membrane-proximal SEA domains of human MUC16 corresponding to residues 13791-14451 of SEQ ID NO: 1899. In some cases, the anti-MUC16 antibody is an antibody or antigen-binding fragment that binds human MUC16 within residues 13810-14451 of SEQ ID NO: 1899. In some cases, the anti-MUC16 antibody is an antibody or antigen-binding fragment that binds to any one of more of SEA1, SEA2, SEA3, SEA4, SEA5, SEA6, SEA7, SEA8, SEA9, SEA10, SEA11, SEA12, SEA13, SEA14, SEA15 or SEA16 of human MUC16.

Cytotoxic agents include any agent that is detrimental to the growth, viability or propagation of cells. The antigen-binding molecules or antibodies of the invention deliver these cytotoxic agents, referred to herein as "payloads", to the target cells. Examples of suitable cytotoxic agents and chemotherapeutic agents for forming ADCs are known in the art.

Examples of suitable cytotoxic agents and chemotherapeutic agents that can be conjugated to anti-MUC16 antibodies in accordance with this aspect of the invention include, e.g., 1-(2chloroethyl)-1,2-dimethanesulfonyl hydrazide, 1,8-dihydroxy-bicyclo[7.3.1]trideca-4,9-diene-2,6-diyne-13-one, 1-dehydrotestosterone, 5-fluorouracil, 6-mercaptopurine, 6-thioguanine, 9-amino camptothecin, actinomycin D, amanitins, aminopterin, anguidine, anthracycline, anthramycin (AMC), auristatins (monomethyl auristatin E or monomethyl auristatin F), bleomycin, busulfan, butyric acid, calicheamicins, camptothecin, carminomycins, carmustine, cemadotins, cisplatin, colchicin, combretastatins, cyclophosphamide, cytarabine, cytochalasin B, dactinomycin, daunorubicin, decarbazine, diacetoxypentyldoxorubicin, dibromomannitol, dihydroxy anthracin dione, disorazoles, dolastatin, doxorubicin, duocarmycin, echinomycins, eleutherobins, emetine, epothilones, esperamicin, estramustines, ethidium bromide, etoposide, fluorouracils, geldanamycins, gramicidin D, glucocorticoids, irinotecans, leptomycins, leurosines, lidocaine, lomustine (CCNU), maytansinoids, mechlorethamine, melphalan, mercatopurines, methopterins, methotrexate, mithramycin, mitomycin, mitoxantrone, N8-acetyl spermidine, podophyllotoxins, procaine, propranolol, pteridines, puromycin, rhizoxins, streptozotocin, tallysomycins, taxol, tenoposide, tetracaine, thioepa chlorambucil, tomaymycins, topotecans, tubulysin, vinblastine, vincristine, vindesine, vinorelbines, and derivatives of any of the foregoing.

According to certain embodiments, the cytotoxic agent that is conjugated to an anti-MUC16 antibody is an auristatin such as monomethyl auristatin E (MMAE) or monomethyl auristatin F (MMAF), a tubulysin such as TUB-OH or TUB-OMOM, a tomaymycin derivative, a dolastatin derivative, or a maytansinoid such as DM1 or DM4. In some embodiments, the cytotoxic agent is a maytansinoid having the structure of Formula (I), including stereoisomers of the compounds of Formula (I):

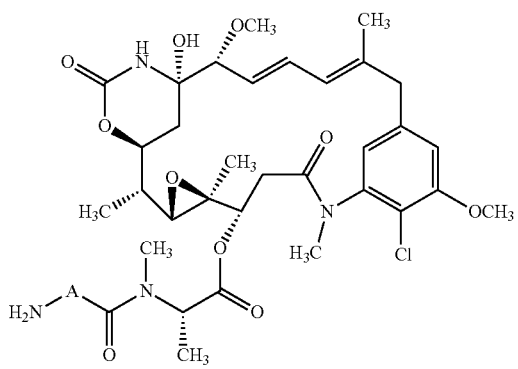
(Formula I)

wherein A is arylene or heteroarylene.

In some embodiments, A is a divalent radical of benzene, of pyridine, of naphthalene, or of quinolone, which are optionally substituted.

In some embodiments, A is arylene.

In some embodiments, A is:

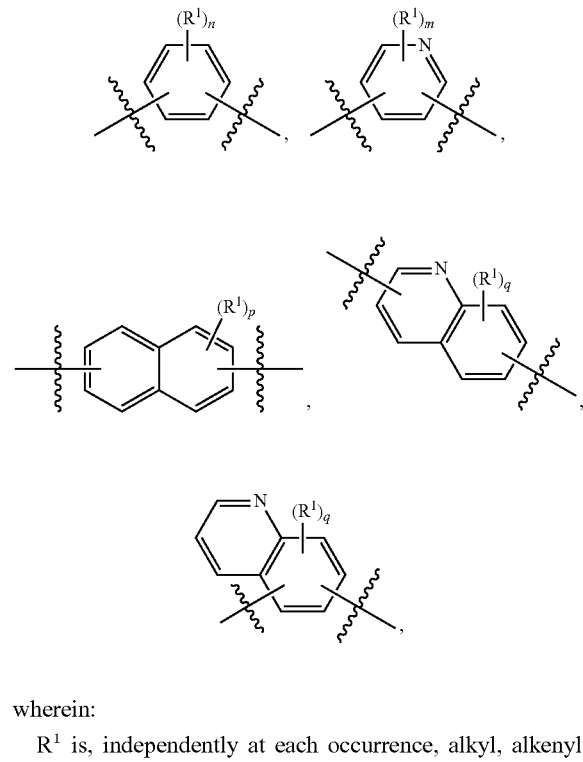

wherein:

R$^1$ is, independently at each occurrence, alkyl, alkenyl, alkynyl, aryl, alkaryl, aralkyl, halo, heteroaryl, heterocycloalkyl, hydroxyl, cyano, nitro,

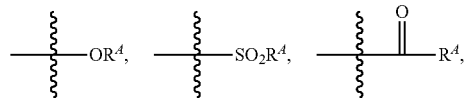

or azido, wherein R$^A$ is alkyl or heteroalkyl;

n is an integer from 0 to 4;

m is and integer from 0 to 3;

p is an integer from 0 to 6; and q is an integer from 0 to 5.

In some embodiments, the compound of Formula I is selected from the group consisting of:

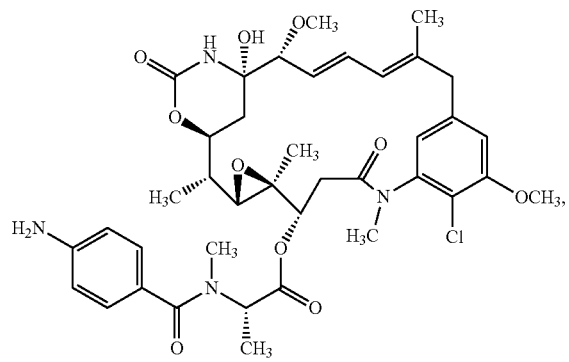

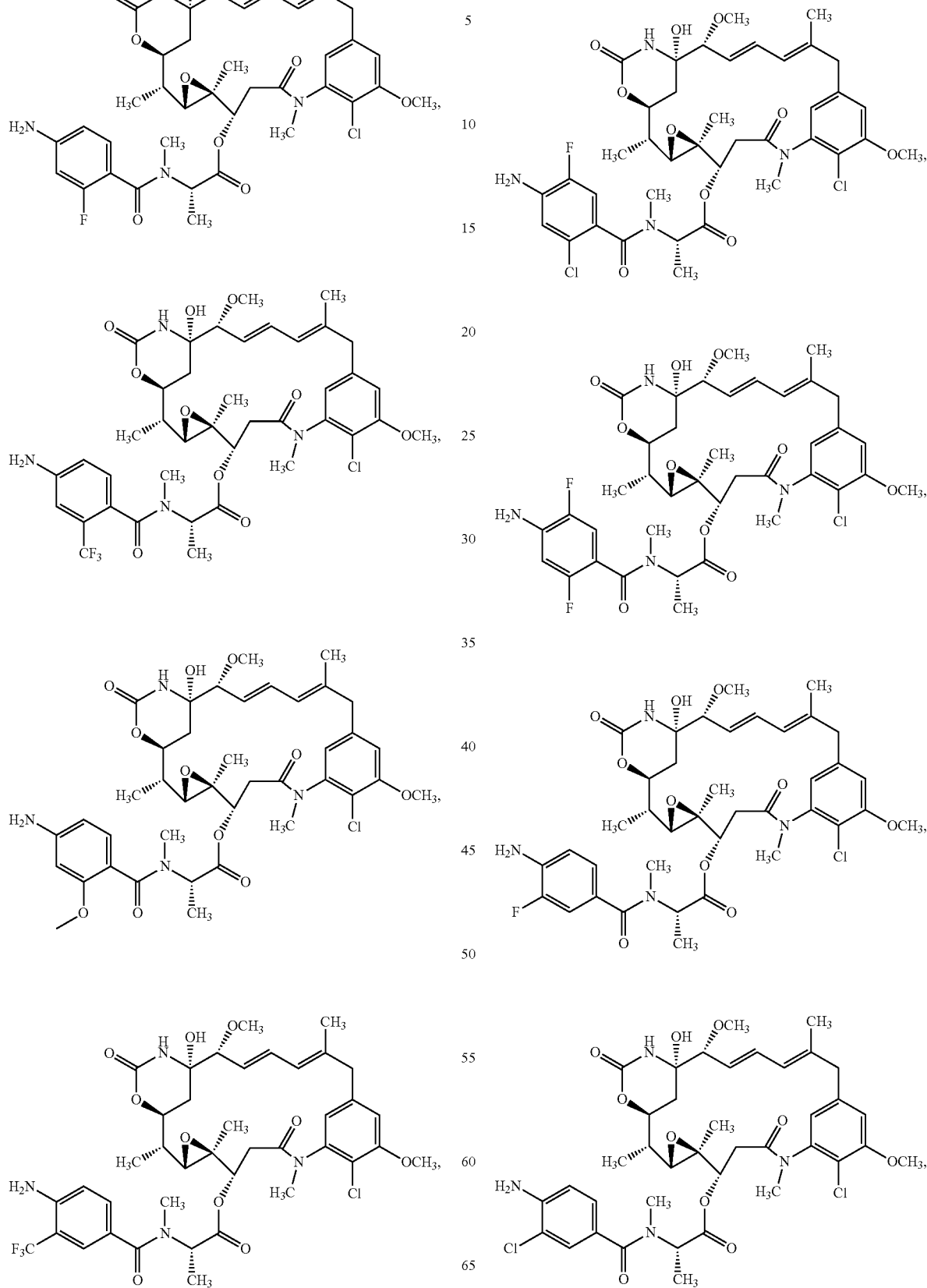

55
-continued
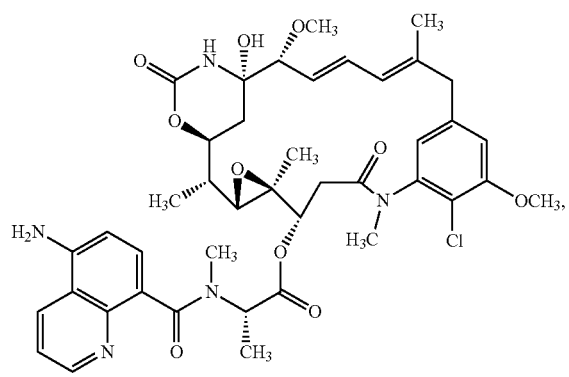
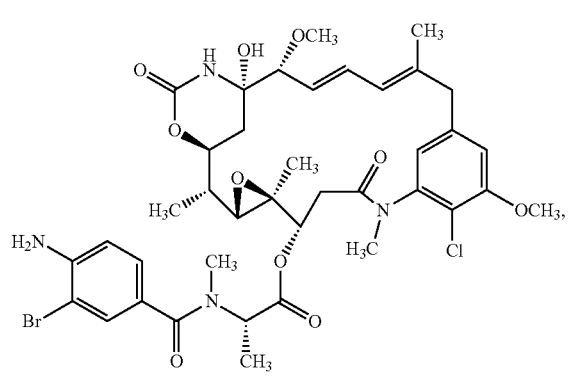
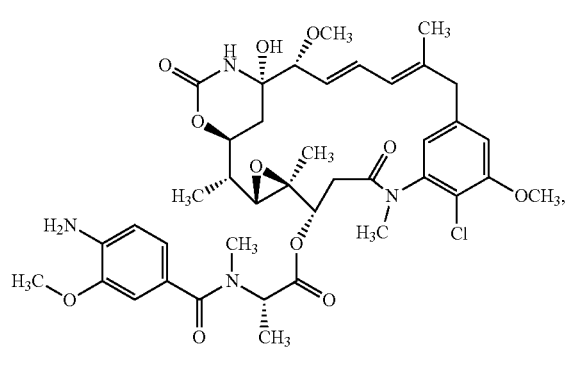
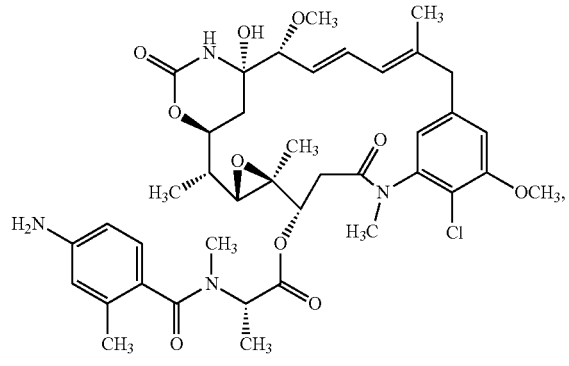
56
-continued
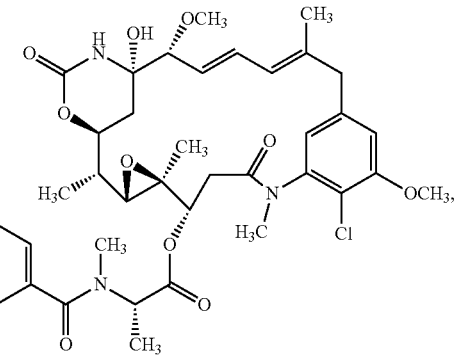
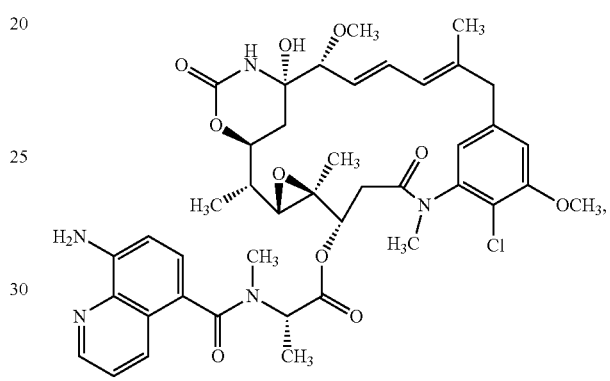
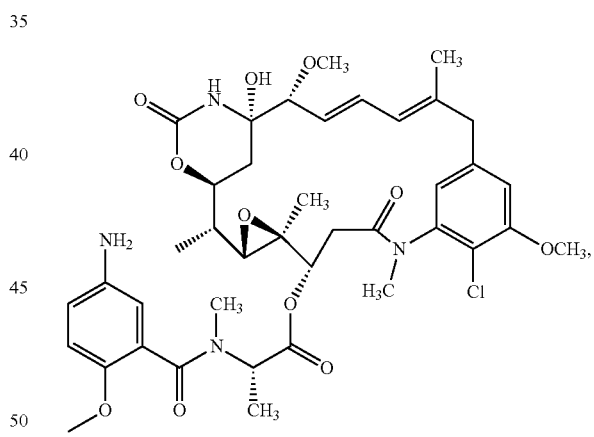
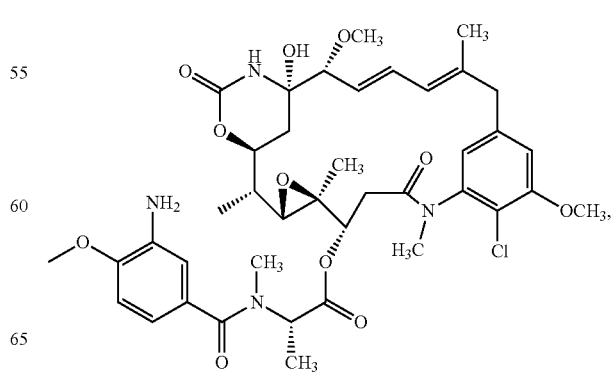

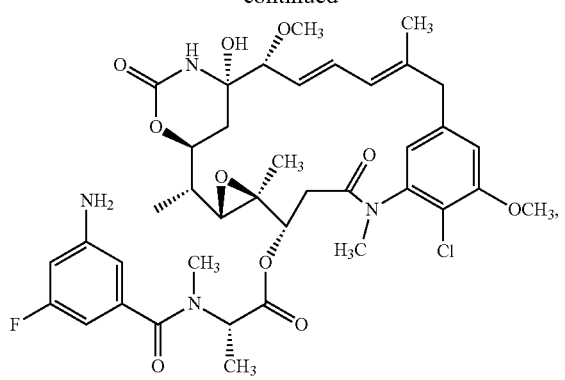
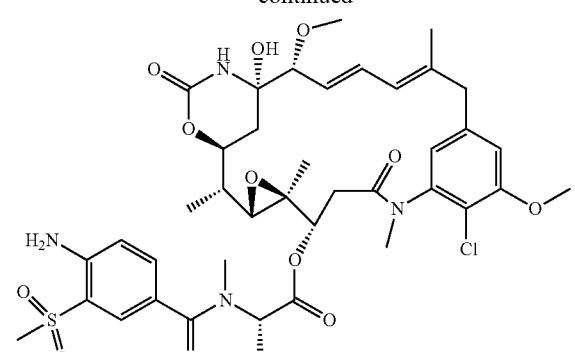
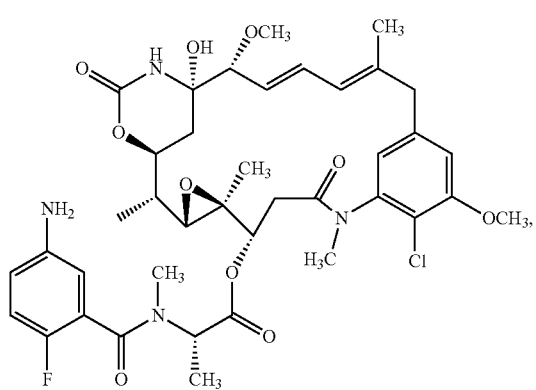
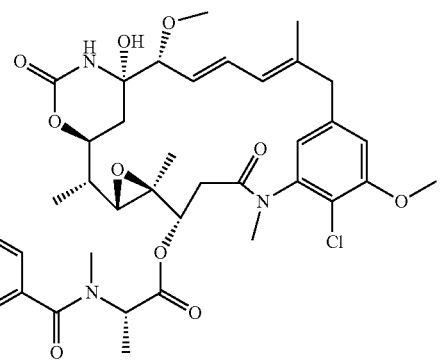
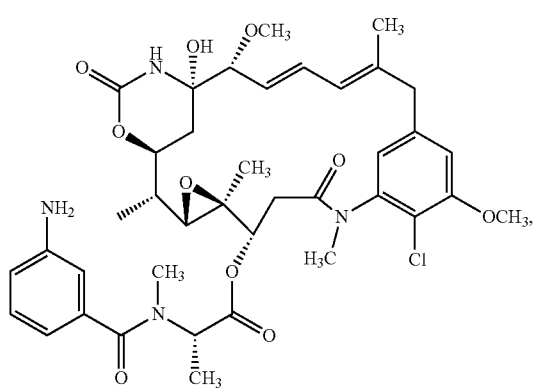
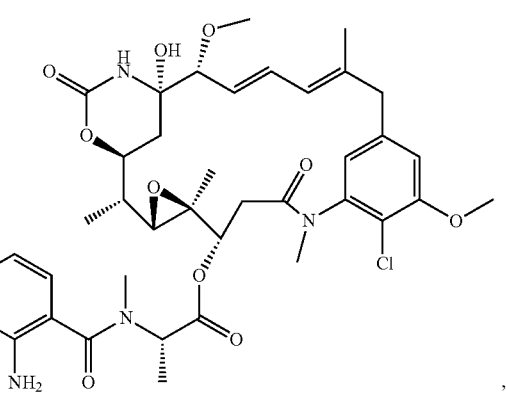
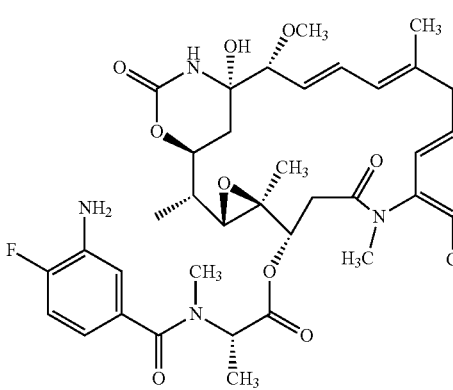
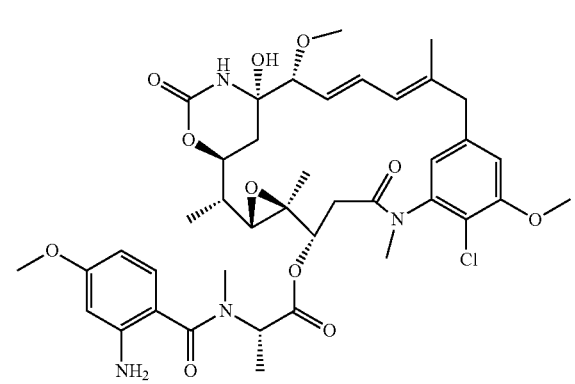

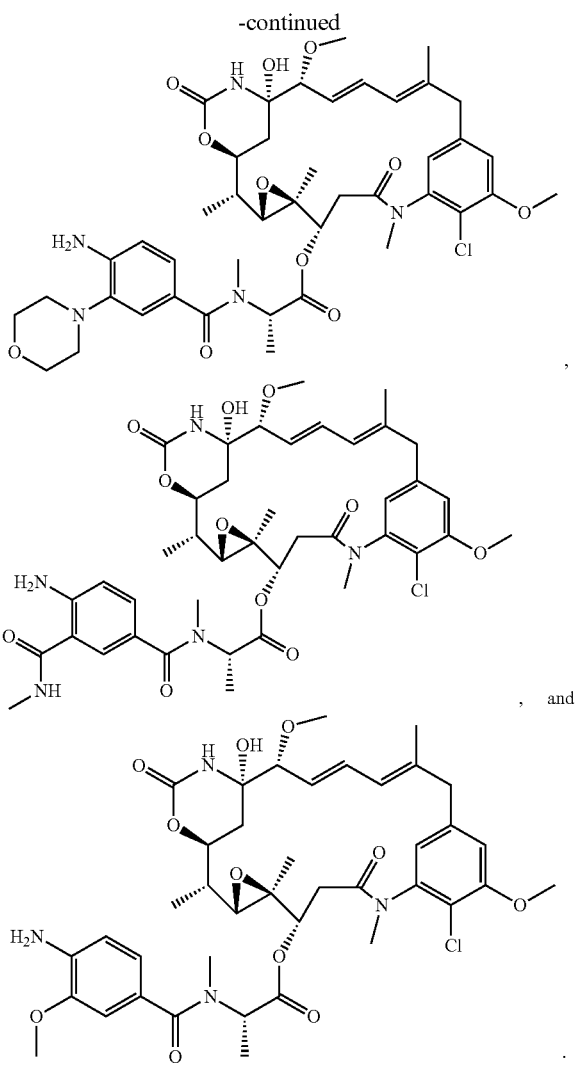

, and

In one embodiment, the compound of Formula (I) is:

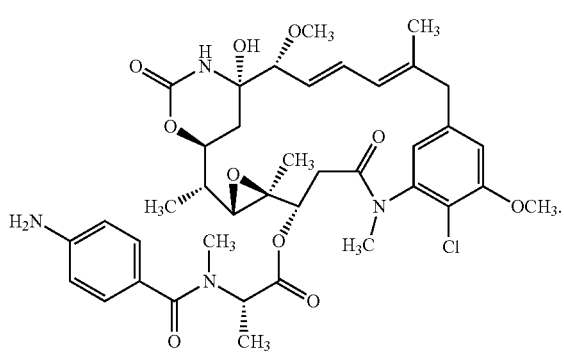 [SMILES: COc1cc2cc(c1Cl)N(C)C(=O)C[C@H](OC(=O)[C@H](C)N(C)C(=O)c1ccc(N)cc1)[C@]1(C)O[C@H]1[C@H](C)[C@@H]1C[C@@](O)(NC(=O)O1)[C@H](OC)/C=C/C=C(\C)C2]

In some embodiments, the maytansinoid of Formula (I) is conjugated to an anti-MUC16 antibody or antigen-binding fragment thereof via a linker, as shown in Formula (IA), below:

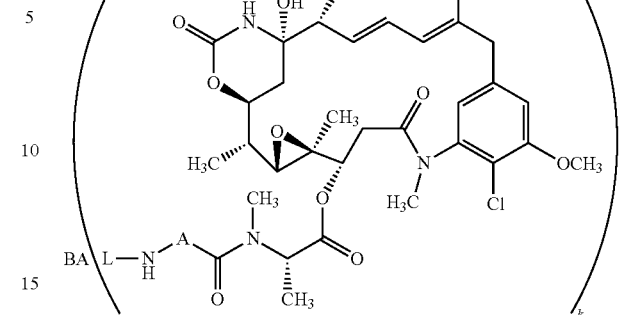

wherein:
A is arylene or heteroarylene, as discussed above in connection with Formula (I);
L is a linker;
BA is an anti-MUC16 antibody or antigen-binding fragment thereof; and
k is an integer from 1 to 30.

In various embodiments, L is:

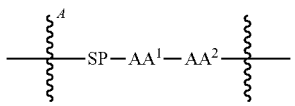

wherein:
SP is a spacer;

is one or more bonds to the anti-MUC16 antibody or fragment thereof;
$AA^1$ is an amino acid; and
$AA^2$ is an amino acid.

In some embodiments, $AA^1$-$AA^2$ is: valine-citrulline, citrulline-valine, lysine-phenylalanine, phenylalanine-lysine, valine-asparagine, asparagine-valine, threonine-asparagine, asparagine-threonine, serine-asparagine, asparagine-serine, phenylalanine-asparagine, asparagine-phenylalanine, leucine-asparagine, asparagine-leucine, isoleucine-asparagine, asparagine-isoleucine, glycine-asparagine, asparagine-glycine, glutamic acid-asparagine, asparagine-glutamic acid, citrulline-asparagine, asparagine-citrulline, alanine-asparagine, or asparagine-alanine.

In some embodiments, SP is:

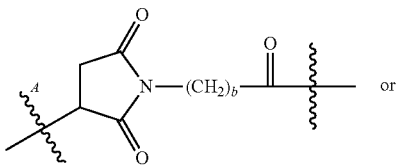

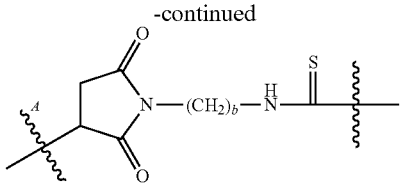
wherein:
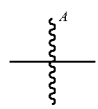
is a bond to the anti-MUC16 antibody or fragment thereof; and
b is an integer from 2 to 8.
In other embodiments, L is:
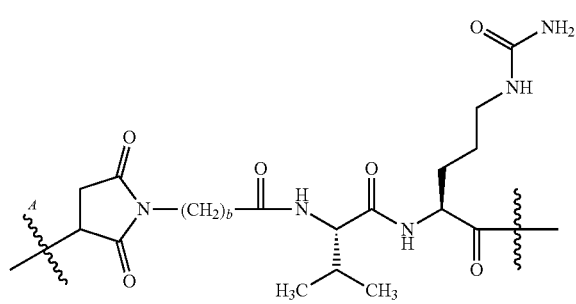
or
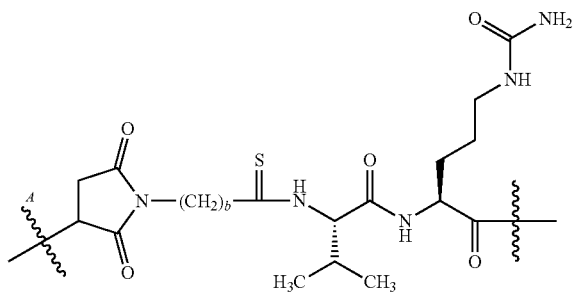
wherein:
is a bond to the anti-MUC16 antibody or fragment thereof; and
b is an integer from 2 to 8.
In one embodiment, the compound of Formula (IA), including the linker, that is bound to the anti-MUC16 antibody or antigen-binding fragment thereof is:
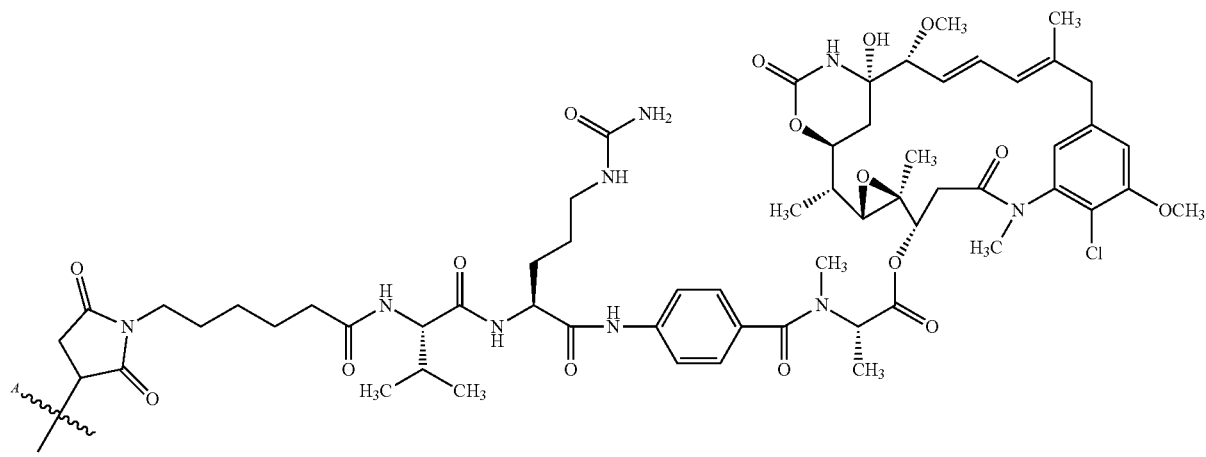

wherein

is a bond to the anti-MUC16 antibody or fragment thereof. In some instances, this moiety is referred to as "Compound 10."

In one embodiment, the compound of Formula (IA), including the linker, that is bound to the anti-MUC16 antibody or antigen-binding fragment thereof is:

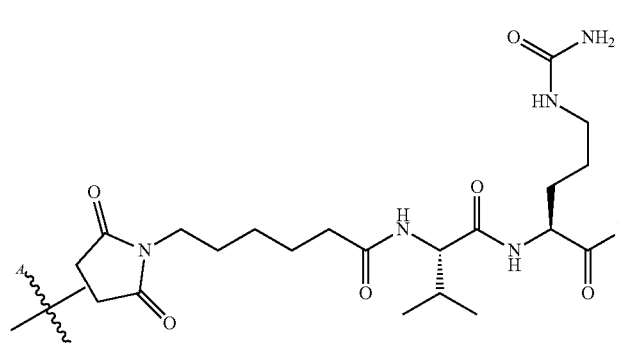

wherein

is a bond to the anti-MUC16 antibody or fragment thereof. In some instances, this moiety is referred to as "Compound 60."

In some embodiments, the cytotoxic agent is a maytansinoid having the structure of Formula (II), including stereoisomers of the compounds of Formula (II):

(Formula II)

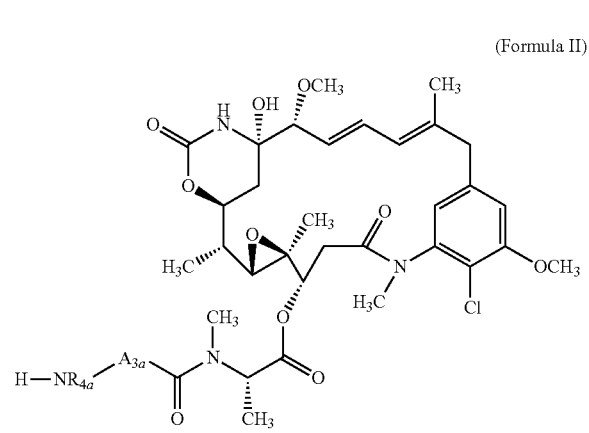

wherein:

$A_{3a}$ is an amino acid, a peptide having 2-20 amino acids, an alkyl, an alkynyl, an alkenyl, a cycloalkyl, an aryl, a heteroaryl, a heterocyclyl, —$CR_5R_6$—, —O—, —C(=O)—, —O—C(=O)—, —C(=O)—O—, —O—C(=O)—O—, —C(=O)—$(CH_x)_{p1}$—, —C(=O)—O—$(CH_x)_{p1}$—, —$(CH_x)_{p1}$—C(=O)—, —$(CH_x)_{p1}$—C(=O)—O—, —(O—$(CH_2)_{p2}$—)$_{p3}$—, —(($CH_2)_{p2}$—O—)$_{p3}$—, —C(=S)—, —C(=S)—S—, —C(=S)—NH—, —S—C(=S)—, —S—C(=S)—S—, —S—, —SO—, —$SO_2$—, —$NR_4$—, —$N(R_4)$—C(=O)—$N(R_8)$—, —$N(R_4)$—C(=O)O—, —$N(R_4)$—C(=O)—, —C(=O)—$N(R_4)$—, —C(=O)—$N(R_4)$—C(=O)—, or —O—C(=O)—$NR_4$—, wherein alkyl, alkynyl, alkenyl, cycloalkyl, aryl, heteroaryl, and heterocyclyl are optionally substituted; and p1, p2 and p3 are each independently 0, or an integer from 1 to 100;

x is 0, 1 or 2;

$R_4$, $R_5$, $R_6$ and $R_8$ are each independently H, or a substituted or unsubstituted: alkyl, alkenyl, alkynyl, aryl, heteroaryl, or heterocyclyl; and $R_{4a}$ is a substituted or unsubstituted: alkyl, alkenyl, alkynyl, aryl, heteroaryl, or heterocyclyl.

In some embodiments, the compound of Formula (II) is selected from the group consisting of:

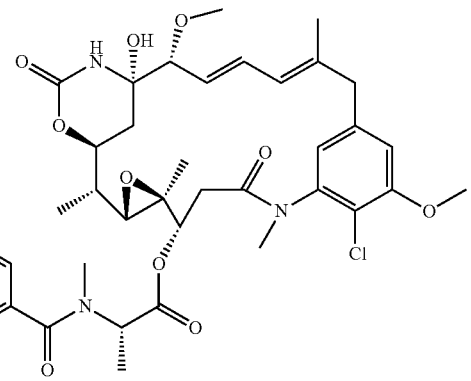

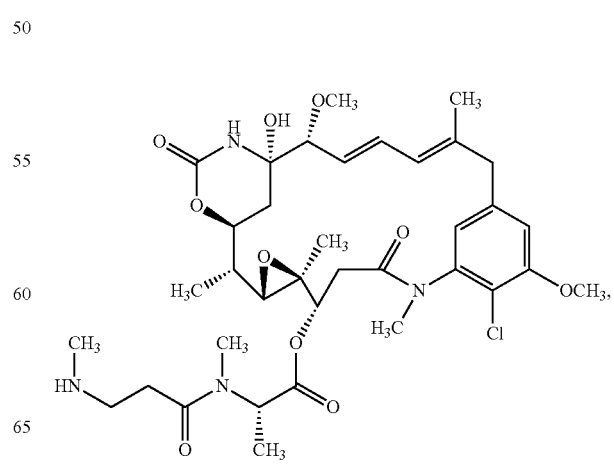

65
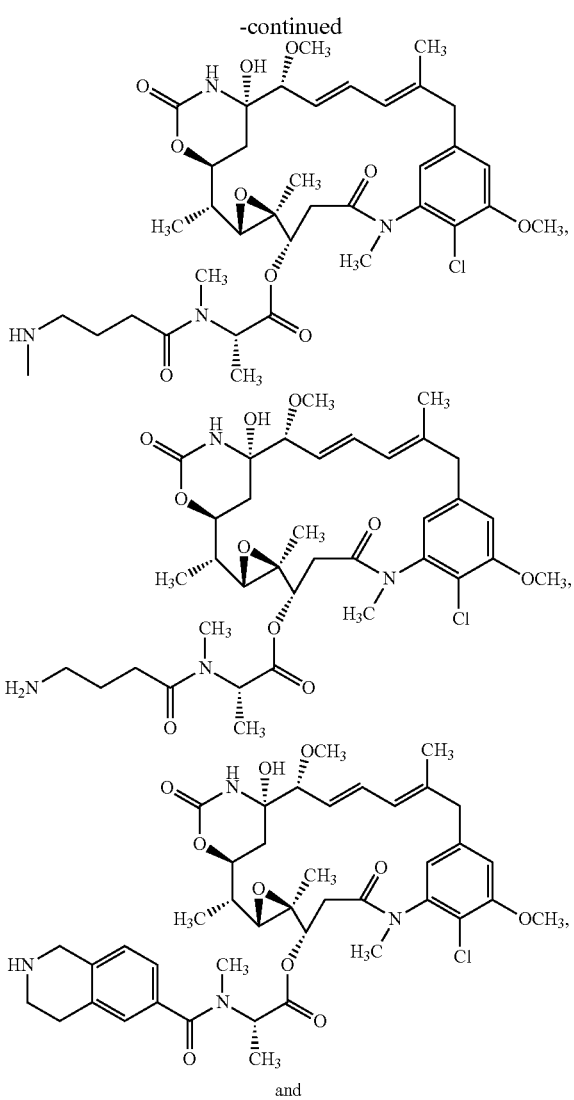
and
66
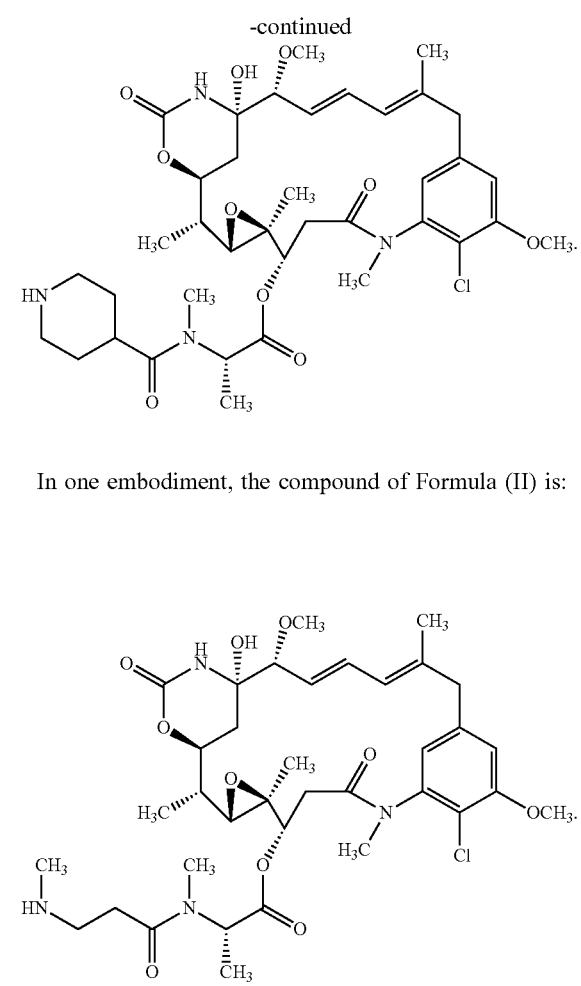
In one embodiment, the compound of Formula (II) is:
In some embodiments, the maytansinoid of Formula (II) is conjugated to an anti-MUC16 antibody or antigen-binding fragment thereof via a linker, as shown in Formula (IIA), below:
(Formula IIA)
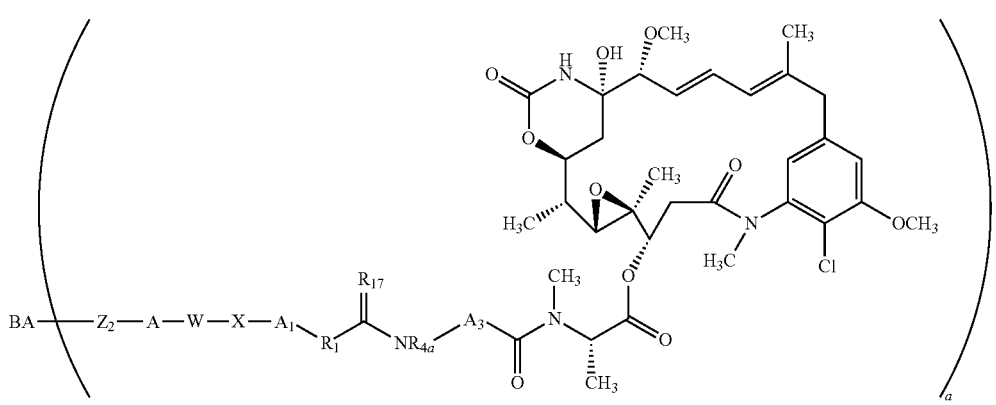

wherein:

BA is an anti-MUC16 antibody or antigen-binding fragment thereof;

a is an integer from 1 to 30;

$Z_2$ is represented by the following structural formula: $-Z_{2A}-Z_{2B}-Z_{2C}-Z_{2D}$, wherein $Z_{2A}$, $Z_{2B}$, $Z_{2C}$ and $Z_{2D}$ are each independently absent, an amino acid, a peptide having 2-20 amino acids, an alkyl, an alkynyl, an alkenyl, a cycloalkyl, an aryl, a heteroaryl, a heterocyclyl, $-CR_5R_6-$, $-O-$, $-C(=O)-$, $-O-C(=O)-$, $-C(=O)-O-$, $-O-C(=O)-O-$, $-C(=O)-(CH_x)_{p1}$, $-C(=O)-O-(CH_x)_{p1}$, $-(CH_x)_{p1}-C(=O)-$, $-(CH_x)_{p1}-C(=O)-O-$, $-(O-(CH_2)_{p2}-)_{p3}-$, $-((CH_2)_{p2}-O-)_{p3}-$, $-C(=S)-$, $-C(=S)-S-$, $-C(=S)-NH-$, $-S-C(=S)-$, $-S-C(=S)-S-$, $-S-$, $-SO-$, $-SO_2-$, $-NR_4-$, $-N(R_4)-C(=O)-N(R_8)-$, $-N(R_4)-C(=O)O-$, $-N(R_4)-C(=O)-$, $-C(=O)-N(R_4)-$, $-C(=O)-N(R_4)-C(=O)-$, $-O-C(=O)-N(R_4)$, $-O-C(=S)-N(R_4)-$, $-C(=S)-N(R_4)-$, $-N=C=S$, $-N=C=O$,

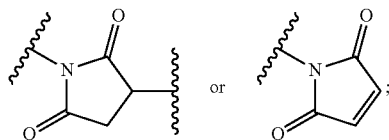 [SMILES: *C1CC(=O)N(*)C1=O ; *N1C(=O)C=CC1=O]

A is a natural or non-natural amino acid, or a peptide comprising 2-20 amino acids;

or $-O-C(=O)-NR_4-$, wherein alkyl, alkynyl, alkenyl, cycloalkyl, aryl, heteroaryl, and heterocyclyl are optionally substituted;

$R_{17}$ is selected from the group consisting of O, S, $NR_{18}$, and $CR_5R_6$;

$R_{18}$ is selected from the group consisting of H, alkyl, alkynyl, alkenyl, cycloalkyl, aryl, heteroaryl, heterocyclyl, and acyl, wherein alkyl, alkynyl, alkenyl, cycloalkyl, aryl, heteroaryl, heterocyclyl, and acyl are optionally substituted;

$R_4$, $R_5$, $R_6$ and $R_8$ are each independently H, or a substituted or unsubstituted: alkyl, alkenyl, alkynyl, aryl, heteroaryl, or heterocyclyl;

$R_{4a}$ is a substituted or unsubstituted: alkyl, alkenyl, alkynyl, aryl, heteroaryl, or heterocyclyl;

p1, p2 and p3 are each independently 0, or an integer from 1 to 100; and x is 0, 1 or 2.

In some embodiments of Formula (IIA), A is a peptide selected from the group consisting of valine-citrulline, citrulline-valine, lysine-phenylalanine, phenylalanine-lysine, valine-asparagine, asparagine-valine, threonine-asparagine, asparagine-threonine, serine-asparagine, asparagine-serine, phenylalanine-asparagine, asparagine-phenylalanine, leucine-asparagine, asparagine-leucine, isoleucine-asparagine, asparagine-isoleucine, glycine-asparagine, asparagine-glycine, glutamic acid-asparagine, asparagine-glutamic acid, citrulline-asparagine, asparagine-citrulline, alanine-asparagine, and asparagine-alanine.

In one embodiment, the compound of Formula (IIA) that is bound to the anti-MUC16 antibody or antigen-binding fragment thereof is:

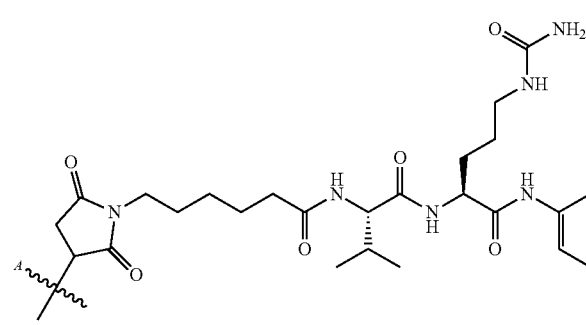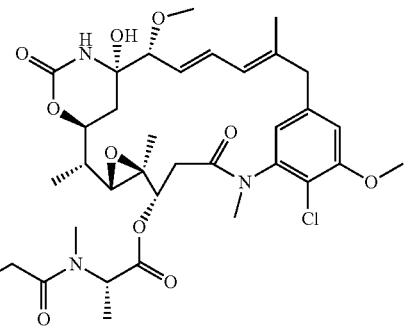

W is $-O-$, $-S-$, $-CR_5R_6-$, or $-NR_4-$;

X is aryl, heteroaryl, cycloalkyl, or heterocyclyl, wherein aryl, heteroaryl, cycloalkyl, and heterocyclyl are optionally substituted;

wherein $A_1$, $A_3$, and $R_1$ are each independently an amino acid, a peptide having 2-20 amino acids, an alkyl, an alkynyl, an alkenyl, a cycloalkyl, an aryl, a heteroaryl, a heterocyclyl, $-CR_5R_6-$, $-O-$, $-C(=O)-$, $-O-C(=O)-$, $-C(=O)-O-$, $-O-C(=O)-O-$, $-C(=O)-(CH_x)_{p1}-$, $-C(=O)-O-(CH_x)_{p1}-$, $-(CH_x)_{p1}-C(=O)-$, $-(CH_x)_{p1}-C(=O)-O-$, $-(O-(CH_2)_{p2}-)_{p3}-$, $-((CH_2)_{p2}-O-)_{p3}-$, $-C(=S)-$, $-C(=S)-S-$, $-S-C(=S)-$, $-C(=S)-NH-$, $-S-C(=S)-S-$, $-S-$, $-SO-$, $-SO_2-$, $-NR_4-$, $-N(R_4)-C(=O)-N(R_8)-$, $-N(R_4)-C(=O)O-$, $-N(R_4)-C(=O)-$, $-C(=O)-N(R_4)-$, $-C(=O)-N(R_4)-C(=O)-$, wherein

is a bond to the anti-MUC16 antibody or fragment thereof. In some instances, this moiety is referred to as "Compound 7."

In some embodiments, the cytotoxic agent that is conjugated to an anti-MUC16 antibody or fragment thereof is a pure, or substantially pure, diastereomer of DM1:

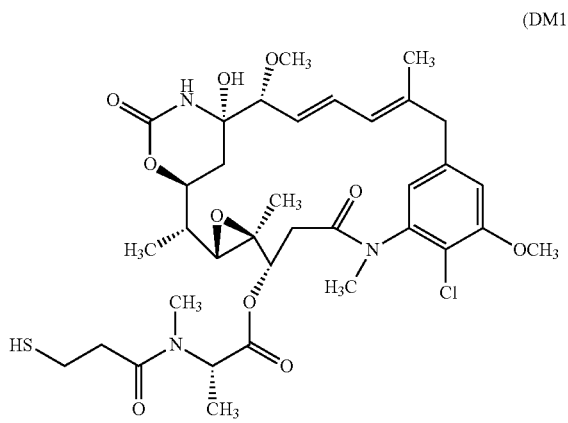

(DM1)

and y is an integer 1 to 0.

In another embodiment, the ADC comprises a "A-[L-P]$_y$" structure in which A is an anti-MUC16 antibody or antigen-binding fragment thereof, and [L-P] is:

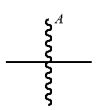

or a mixture thereof, and
wherein y is an integer 1 to 30, and is a bond to the anti-MUC16 antibody or fragment thereof.

Other maytansinoid derivatives are discussed in WO 2014/145090, WO2016/160615, and WO 2015/031396, each of which is hereby incorporated by reference in its entirety.

In some embodiments, the cytotoxic agent that is conjugated to an anti-MUC16 antibody or fragment thereof is MMAE or MMAF.

Other cytotoxic agents known in the art are contemplated within the scope of the present invention, including, e.g., protein toxins such as ricin, *C. difficile* toxin, *pseudomonas* exotoxin, diphtheria toxin, botulinum toxin, bryodin, saporin, pokeweed toxins (i.e., phytolaccatoxin and phytolaccigenin), and others such as those set forth in Sapra et al., *Pharmacol. & Therapeutics,* 2013, 138:452-469.

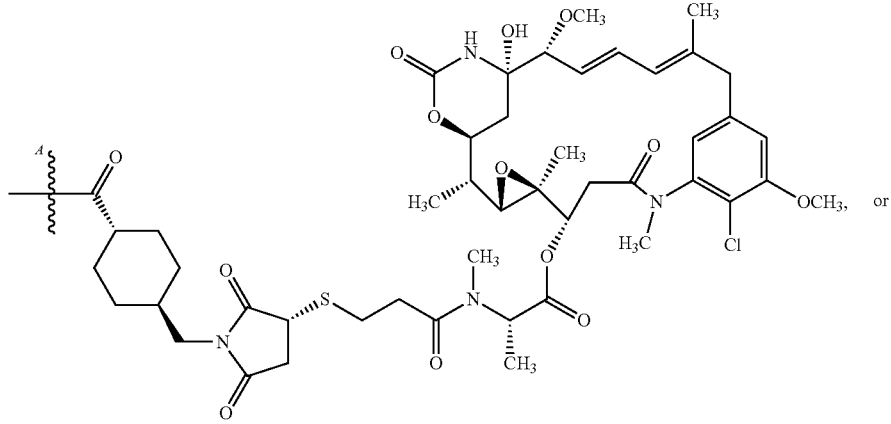

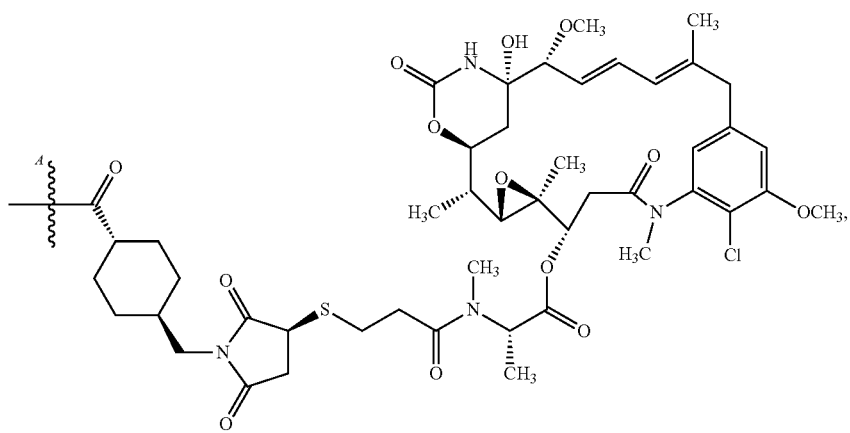

Cytotoxic agents ("payloads") can be tethered to an anti-MUC16 antigen-binding molecule or antibody of the invention via a chemical linker that covalently binds the payload compound to the protein molecule (i.e. antibody). Exemplary embodiments of specific linkers are discussed above. More generally, and as used herein, the term "linker" refers to any divalent group or moiety that links, connects, or bonds a binding agent (e.g., an antibody or an antigen-binding fragment thereof) with a payload compound set forth herein. Generally, suitable binding agent linkers for the antibody conjugates described herein are those that are sufficiently stable to exploit the circulating half-life of the antibody and, at the same time, capable of releasing its payload after antigen-mediated internalization of the conjugate. Linkers can be cleavable or non-cleavable. Cleavable linkers are linkers that are cleaved by intracellular metabolism following internalization, e.g., cleavage via hydrolysis, reduction, or enzymatic reaction. Non-cleavable linkers are linkers that release an attached payload via lysosomal degradation of the antibody following internalization. Suitable linkers include, but are not limited to, acid-labile linkers, hydrolysis-labile linkers, enzymatically cleavable linkers, reduction labile linkers, self-immolative linkers, and non-cleavable linkers. Suitable linkers also include, but are not limited to, those that are or comprise peptides, glucuronides, succinimide-thioethers, polyethylene glycol (PEG) units, hydrazones, mal-caproyl units, dipeptide units, valine-citrulline units, and para-aminobenzyl (PAB) units. In some cases, the linker is capable of bonding to the antibody or antigen-binding fragment through a lysine residue or a cysteine residue (e.g., via cleavage of a disulfide group of the antibody or fragment, or via a cysteine residue engineered into the antibody or fragment). In some cases, the linker is capable of bonding to the antibody or fragment through a glutamine residue, including those derived via transglutaminase-mediated conjugation.

Exemplary linkers that can be used in the context of the present invention include linkers that comprise or consist of e.g., MC (6-maleimidocaproyl), MCC (maleimidomethyl cyclohexane-1-carboxylate), MP (maleimidopropanoyl), val-cit (valine-citrulline), val-ala (valine-alanine), ala-phe (alanine-phenylalanine), phe-lys (phenylalanine-lysine), dipeptide site in protease-cleavable linker, PAB (p-aminobenzyloxycarbonyl), SPP (N-Succinimidyl 4-(2-pyridylthio) pentanoate), SMCC (N-Succinimidyl 4-(N-maleimidomethyl)cyclohexane-1 carboxylate), SIAB (N-Succinimidyl (4-iodo-acetyl)aminobenzoate), and variants and combinations thereof. Additional examples of linkers that can be used in the context of the present invention are disclosed in, e.g., U.S. Pat. No. 7,754,681 and in Ducry, Bioconjugate Chem., 2010, 21:5-13, and the references cited therein, the contents of which are incorporated by reference herein in their entireties. In some cases, the linker is or contains a self-immolative spacer, such as those discussed in Jin, et al., *Bioorganic & Medicinal Chemistry*, 2012, 20:3465-3469, and Wu, et al., *Bioorganic & Medicinal Chemistry*, 2016, 24:2697-2706.

Payloads may be linked to the anti-MUC16 antibody or antigen-binding fragment via an attachment at a particular amino acid within the antibody or antigen-binding molecule. Exemplary amino acid attachments that can be used in the context of this aspect of the invention include, e.g., lysine (see, e.g., U.S. Pat. No. 5,208,020; US 2010/0129314; Hollander et al., Bioconjugate Chem., 2008, 19:358-361; WO 2005/089808; U.S. Pat. No. 5,714,586; US 2013/0101546; and US 2012/0585592), cysteine (see, e.g., US 2007/0258987; WO 2013/055993; WO 2013/055990; WO 2013/053873; WO 2013/053872; WO 2011/130598; US 2013/0101546; and U.S. Pat. No. 7,750,116), selenocysteine (see, e.g., WO 2008/122039; and Hofer et al., Proc. Natl. Acad. Sci., USA, 2008, 105:12451-12456), formyl glycine (see, e.g., Carrico et al., Nat. Chem. Biol., 2007, 3:321-322; Agarwal et al., Proc. Natl. Acad. Sci., USA, 2013, 110:46-51, and Rabuka et al., Nat. Protocols, 2012, 10:1052-1067), non-natural amino acids (see, e.g., WO 2013/068874, and WO 2012/166559), and acidic amino acids (see, e.g., WO 2012/05982). Linkers can also be conjugated to an antigen-binding protein via attachment to carbohydrates (see, e.g., US 2008/0305497, and Ryan et al., Food & Agriculture Immunol., 2001, 13:127-130) and disulfide linkers (see, e.g., WO 2013/085925, WO 2010/010324, WO 2011/018611, and Shaunak et al., Nat. Chem. Biol., 2006, 2:312-313).

Drug-to-antibody ratio (DAR) is the average number of drugs conjugated to the antibody or antigen-binding fragment, which has an important effect on the efficacy, potency and pharmacokinetics of the ADC. In various embodiments, the DAR is from 1, 2, 3, 4, 5, 6, 7, or 8 drug molecules per antibody. In some embodiments, the DAR is from 1 to 4. In certain embodiments, the DAR is from 2 to 4. In some cases, the DAR is from 2 to 3. In certain cases, the DAR is from 3 to 4. In some embodiments, the DAR is from 1 to 10, 1 to 20 or 1 to 30 (i.e., from 1 to 30 drug molecules per antibody or antigen-binding fragment thereof).

Therapeutic Formulation and Administration

The present invention provides pharmaceutical compositions comprising the antigen-binding molecules of the present invention. The pharmaceutical compositions of the invention are formulated with suitable carriers, excipients, and other agents that provide improved transfer, delivery, tolerance, and the like. A multitude of appropriate formulations can be found in the formulary known to all pharmaceutical chemists: Remington's Pharmaceutical Sciences, Mack Publishing Company, Easton, Pa. These formulations include, for example, powders, pastes, ointments, jellies, waxes, oils, lipids, lipid (cationic or anionic) containing vesicles (such as LIPOFECTIN™, Life Technologies, Carlsbad, Calif.), DNA conjugates, anhydrous absorption pastes, oil-in-water and water-in-oil emulsions, emulsions carbowax (polyethylene glycols of various molecular weights), semi-solid gels, and semi-solid mixtures containing carbowax. See also Powell et al. "Compendium of excipients for parenteral formulations" PDA (1998) J Pharm Sci Technol 52:238-311.

The dose of antigen-binding molecule administered to a patient may vary depending upon the age and the size of the patient, target disease, conditions, route of administration, and the like. The preferred dose is typically calculated according to body weight or body surface area. When a bispecific antigen-binding molecule of the present invention is used for therapeutic purposes in an adult patient, it may be advantageous to intravenously administer the bispecific antigen-binding molecule of the present invention normally at a single dose of about 0.01 to about 20 mg/kg body weight, more preferably about 0.02 to about 7, about 0.03 to about 5, or about 0.05 to about 3 mg/kg body weight. Depending on the severity of the condition, the frequency and the duration of the treatment can be adjusted. Effective dosages and schedules for administering a bispecific antigen-binding molecule may be determined empirically; for example, patient progress can be monitored by periodic assessment, and the dose adjusted accordingly. Moreover, interspecies scaling of dosages can be performed using well-known methods in the art (e.g., Mordenti et al., 1991, *Pharmaceut. Res.* 8:1351).

Various delivery systems are known and can be used to administer the pharmaceutical composition of the invention, e.g., encapsulation in liposomes, microparticles, microcapsules, recombinant cells capable of expressing the mutant viruses, receptor mediated endocytosis (see, e.g., Wu et al., 1987, J. Biol. Chem. 262:4429-4432). Methods of introduction include, but are not limited to, intradermal, intramuscular, intraperitoneal, intravenous, subcutaneous, intranasal, epidural, and oral routes. The composition may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local.

A pharmaceutical composition of the present invention can be delivered subcutaneously or intravenously with a standard needle and syringe. In addition, with respect to subcutaneous delivery, a pen delivery device readily has applications in delivering a pharmaceutical composition of the present invention. Such a pen delivery device can be reusable or disposable. A reusable pen delivery device generally utilizes a replaceable cartridge that contains a pharmaceutical composition. Once all of the pharmaceutical composition within the cartridge has been administered and the cartridge is empty, the empty cartridge can readily be discarded and replaced with a new cartridge that contains the pharmaceutical composition. The pen delivery device can then be reused. In a disposable pen delivery device, there is no replaceable cartridge. Rather, the disposable pen delivery device comes prefilled with the pharmaceutical composition held in a reservoir within the device. Once the reservoir is emptied of the pharmaceutical composition, the entire device is discarded.

Numerous reusable pen and autoinjector delivery devices have applications in the subcutaneous delivery of a pharmaceutical composition of the present invention. Examples include, but are not limited to AUTOPEN™ (Owen Mumford, Inc., Woodstock, UK), DISETRONIC™ pen (Disetronic Medical Systems, Bergdorf, Switzerland), HUMALOG MIX 75/25™ pen, HUMALOG™ pen, HUMALIN 70/30™ pen (Eli Lilly and Co., Indianapolis, Ind.), NOVOPEN™ I, II and III (Novo Nordisk, Copenhagen, Denmark), NOVOPEN JUNIOR™ (Novo Nordisk, Copenhagen, Denmark), BD™ pen (Becton Dickinson, Franklin Lakes, N.J.), OPTIPEN™, OPTIPEN PRO™, OPTIPEN STARLET™, and OPTICLIK™ (sanofi-aventis, Frankfurt, Germany), to name only a few. Examples of disposable pen delivery devices having applications in subcutaneous delivery of a pharmaceutical composition of the present invention include, but are not limited to the SOLOSTAR™ pen (sanofi-aventis), the FLEXPEN™ (Novo Nordisk), and the KWIKPEN™ (Eli Lilly), the SURECLICK™ Autoinjector (Amgen, Thousand Oaks, Calif.), the PENLET™ (Haselmeier, Stuttgart, Germany), the EPIPEN (Dey, L.P.), and the HUMIRA™ Pen (Abbott Labs, Abbott Park Ill.), to name only a few.

In certain situations, the pharmaceutical composition can be delivered in a controlled release system. In one embodiment, a pump may be used (see Langer, supra; Sefton, 1987, CRC Crit. Ref. Biomed. Eng. 14:201). In another embodiment, polymeric materials can be used; see, Medical Applications of Controlled Release, Langer and Wise (eds.), 1974, CRC Pres., Boca Raton, Fla. In yet another embodiment, a controlled release system can be placed in proximity of the composition's target, thus requiring only a fraction of the systemic dose (see, e.g., Goodson, 1984, in Medical Applications of Controlled Release, supra, vol. 2, pp. 115-138). Other controlled release systems are discussed in the review by Langer, 1990, Science 249:1527-1533.

The injectable preparations may include dosage forms for intravenous, subcutaneous, intracutaneous and intramuscular injections, drip infusions, etc. These injectable preparations may be prepared by methods publicly known. For example, the injectable preparations may be prepared, e.g., by dissolving, suspending or emulsifying the antibody or its salt described above in a sterile aqueous medium or an oily medium conventionally used for injections. As the aqueous medium for injections, there are, for example, physiological saline, an isotonic solution containing glucose and other auxiliary agents, etc., which may be used in combination with an appropriate solubilizing agent such as an alcohol (e.g., ethanol), a polyalcohol (e.g., propylene glycol, polyethylene glycol), a nonionic surfactant [e.g., polysorbate 80, HCO-50 (polyoxyethylene (50 mol) adduct of hydrogenated castor oil)], etc. As the oily medium, there are employed, e.g., sesame oil, soybean oil, etc., which may be used in combination with a solubilizing agent such as benzyl benzoate, benzyl alcohol, etc. The injection thus prepared is preferably filled in an appropriate ampoule.

Advantageously, the pharmaceutical compositions for oral or parenteral use described above are prepared into dosage forms in a unit dose suited to fit a dose of the active ingredients. Such dosage forms in a unit dose include, for example, tablets, pills, capsules, injections (ampoules), suppositories, etc. The amount of the aforesaid antibody contained is generally about 5 to about 500 mg per dosage form in a unit dose; especially in the form of injection, it is preferred that the aforesaid antibody is contained in about 5 to about 100 mg and in about 10 to about 250 mg for the other dosage forms.

Therapeutic Uses of the Antigen-Binding Molecules

The present invention includes methods comprising administering to a subject in need thereof a therapeutic composition comprising an anti-MUC16 antibody or antigen-binding fragment thereof, or a bispecific antigen-binding molecule that specifically binds CD3 and MUC16. The therapeutic composition can comprise any of the antibodies or bispecific antigen-binding molecules as disclosed herein and a pharmaceutically acceptable carrier or diluent. As used herein, the expression "a subject in need thereof" means a human or non-human animal that exhibits one or more symptoms or indicia of cancer (e.g., a subject expressing a tumor or suffering from any of the cancers mentioned herein below), or who otherwise would benefit from an inhibition or reduction in MUC16 activity or a depletion of MUC16+ cells (e.g., ovarian cancer cells).

The antibodies and bispecific antigen-binding molecules of the invention (and therapeutic compositions comprising the same) are useful, inter alia, for treating any disease or disorder in which stimulation, activation and/or targeting of an immune response would be beneficial. In particular, the anti-MUC16 antibodies or the anti-CD3/anti-MUC16 bispecific antigen-binding molecules of the present invention may be used for the treatment, prevention and/or amelioration of any disease or disorder associated with or mediated by MUC16 expression or activity or the proliferation of MUC16+ cells. The mechanism of action by which the therapeutic methods of the invention are achieved include killing of the cells expressing MUC16 in the presence of effector cells, for example, by CDC, apoptosis, ADCC, phagocytosis, or by a combination of two or more of these mechanisms. Cells expressing MUC16 which can be inhibited or killed using the bispecific antigen-binding molecules of the invention include, for example, ovarian cancer cells.

The antigen-binding molecules of the present invention may be used to treat a disease or disorder associates with MUC16 expression including, e.g., a cancer including ovarian cancer, breast cancer, pancreatic cancer, non-small-cell lung cancer, intrahepatic cholangiocarcinoma-mass forming type, adenocarcinoma of the uterine cervix, and adenocarcinoma of the gastric tract. According to certain embodiments of the present invention, the anti-MUC16 antibodies or anti-MUC16/anti-CD3 bispecific antibodies are useful for treating a patient afflicted with ovarian cancer. According to other related embodiments of the invention, methods are provided comprising administering an anti-MUC16 antibody or an anti-CD3/anti-MUC16 bispecific antigen-binding molecule as disclosed herein to a patient who is afflicted with ovarian cancer. Analytic/diagnostic methods known in the art, such as tumor scanning, etc., may be used to ascertain whether a patient harbors an ovarian tumor.

The present invention also includes methods for treating residual cancer in a subject. As used herein, the term "residual cancer" means the existence or persistence of one or more cancerous cells in a subject following treatment with an anti-cancer therapy.

According to certain aspects, the present invention provides methods for treating a disease or disorder associated with MUC16 expression (e.g., ovarian cancer) comprising administering one or more of the anti-MUC16 or bispecific antigen-binding molecules described elsewhere herein to a subject after the subject has been determined to have prostate cancer. For example, the present invention includes methods for treating ovarian cancer comprising administering an anti-MUC16 antibody or an anti-CD3/anti-MUC16 bispecific antigen-binding molecule to a patient 1 day, 2 days, 3 days, 4 days, 5 days, 6 days, 1 week, 2 weeks, 3 weeks or 4 weeks, 2 months, 4 months, 6 months, 8 months, 1 year, or more after the subject has received hormone therapy (e.g., anti-androgen therapy).

Combination Therapies and Formulations

The present invention provides methods which comprise administering a pharmaceutical composition comprising any of the exemplary antibodies and bispecific antigen-binding molecules described herein in combination with one or more additional therapeutic agents. Exemplary additional therapeutic agents that may be combined with or administered in combination with an antigen-binding molecule of the present invention include, e.g., an EGFR antagonist (e.g., an anti-EGFR antibody [e.g., cetuximab or panitumumab] or small molecule inhibitor of EGFR [e.g., gefitinib or erlotinib]), an antagonist of another EGFR family member such as Her2/ErbB2, ErbB3 or ErbB4 (e.g., anti-ErbB2, anti-ErbB3 or anti-ErbB4 antibody or small molecule inhibitor of ErbB2, ErbB3 or ErbB4 activity), an antagonist of EGFRvIII (e.g., an antibody that specifically binds EGFRvIII), a cMET anagonist (e.g., an anti-cMET antibody), an IGF1R antagonist (e.g., an anti-IGF1R antibody), a B-raf inhibitor (e.g., vemurafenib, sorafenib, GDC-0879, PLX-4720), a PDGFR-α inhibitor (e.g., an anti-PDGFR-α antibody), a PDGFR-β inhibitor (e.g., an anti-PDGFR-β antibody), a VEGF antagonist (e.g., a VEGF-Trap, see, e.g., U.S. Pat. No. 7,087,411 (also referred to herein as a "VEGF-inhibiting fusion protein"), anti-VEGF antibody (e.g., bevacizumab), a small molecule kinase inhibitor of VEGF receptor (e.g., sunitinib, sorafenib or pazopanib)), a DLL4 antagonist (e.g., an anti-DLL4 antibody disclosed in US 2009/0142354 such as REGN421), an Ang2 antagonist (e.g., an anti-Ang2 antibody disclosed in US 2011/0027286 such as H1H685P), a FOLH1 (PSMA) antagonist, a PRLR antagonist (e.g., an anti-PRLR antibody), a STEAP1 or STEAP2 antagonist (e.g., an anti-STEAP1 antibody or an anti-STEAP2 antibody), a TMPRSS2 antagonist (e.g., an anti-TMPRSS2 antibody), a MSLN antagonist (e.g., an anti-MSLN antibody), a CA9 antagonist (e.g., an anti-CA9 antibody), a uroplakin antagonist (e.g., an anti-uroplakin antibody), etc. Other agents that may be beneficially administered in combination with the antigen-binding molecules of the invention include cytokine inhibitors, including small-molecule cytokine inhibitors and antibodies that bind to cytokines such as IL-1, IL-2, IL-3, IL-4, IL-5, IL-6, IL-8, IL-9, IL-11, IL-12, IL-13, IL-17, IL-18, or to their respective receptors. The pharmaceutical compositions of the present invention (e.g., pharmaceutical compositions comprising an anti-CD3/anti-MUC16 bispecific antigen-binding molecule as disclosed herein) may also be administered as part of a therapeutic regimen comprising one or more therapeutic combinations selected from "ICE": ifosfamide (e.g., Ifex®), carboplatin (e.g., Paraplatin®), etoposide (e.g., Etopophos®, Toposar@, VePesid®, VP-16); "DHAP": dexamethasone (e.g., Decadron®), cytarabine (e.g., Cytosar-U®, cytosine arabinoside, ara-C), cisplatin (e.g., Platinol®-AQ); and "ESHAP": etoposide (e.g., Etopophos®, Toposar®, VePesid®, VP-16), methylprednisolone (e.g., Medrol®), high-dose cytarabine, cisplatin (e.g., Platinol®-AQ).

The present invention also includes therapeutic combinations comprising any of the antigen-binding molecules mentioned herein and an inhibitor of one or more of VEGF, Ang2, DLL4, EGFR, ErbB2, ErbB3, ErbB4, EGFRvIII, cMet, IGF1R, B-raf, PDGFR-α, PDGFR-β, FOLH1 (PSMA), PRLR, STEAP1, STEAP2, TMPRSS2, MSLN, CA9, uroplakin, or any of the aforementioned cytokines, wherein the inhibitor is an aptamer, an antisense molecule, a ribozyme, an siRNA, a peptibody, a nanobody or an antibody fragment (e.g., Fab fragment; F(ab')$_2$ fragment; Fd fragment; Fv fragment; scFv; dAb fragment; or other engineered molecules, such as diabodies, triabodies, tetrabodies, minibodies and minimal recognition units). The antigen-binding molecules of the invention may also be administered and/or co-formulated in combination with antivirals, antibiotics, analgesics, corticosteroids and/or NSAIDs. The antigen-binding molecules of the invention may also be administered as part of a treatment regimen that also includes radiation treatment and/or conventional chemotherapy.

The additional therapeutically active component(s) may be administered just prior to, concurrent with, or shortly after the administration of an antigen-binding molecule of the present invention; (for purposes of the present disclosure, such administration regimens are considered the administration of an antigen-binding molecule "in combination with" an additional therapeutically active component).

The present invention includes pharmaceutical compositions in which an antigen-binding molecule of the present invention is co-formulated with one or more of the additional therapeutically active component(s) as described elsewhere herein.

Administration Regimens

According to certain embodiments of the present invention, multiple doses of an antigen-binding molecule (e.g., an anti-MUC16 antibody or a bispecific antigen-binding molecule that specifically binds MUC16 and CD3) may be administered to a subject over a defined time course. The methods according to this aspect of the invention comprise sequentially administering to a subject multiple doses of an antigen-binding molecule of the invention. As used herein, "sequentially administering" means that each dose of an antigen-binding molecule is administered to the subject at a different point in time, e.g., on different days separated by a predetermined interval (e.g., hours, days, weeks or months). The present invention includes methods which comprise sequentially administering to the patient a single initial dose of an antigen-binding molecule, followed by one or more secondary doses of the antigen-binding molecule, and optionally followed by one or more tertiary doses of the antigen-binding molecule.

The terms "initial dose," "secondary doses," and "tertiary doses," refer to the temporal sequence of administration of the antigen-binding molecule of the invention. Thus, the "initial dose" is the dose which is administered at the beginning of the treatment regimen (also referred to as the "baseline dose"); the "secondary doses" are the doses which are administered after the initial dose; and the "tertiary doses" are the doses which are administered after the secondary doses. The initial, secondary, and tertiary doses may all contain the same amount of the antigen-binding molecule, but generally may differ from one another in terms of frequency of administration. In certain embodiments, however, the amount of an antigen-binding molecule contained in the initial, secondary and/or tertiary doses varies from one another (e.g., adjusted up or down as appropriate) during the course of treatment. In certain embodiments, two or more (e.g., 2, 3, 4, or 5) doses are administered at the beginning of the treatment regimen as "loading doses" followed by subsequent doses that are administered on a less frequent basis (e.g., "maintenance doses").

In one exemplary embodiment of the present invention, each secondary and/or tertiary dose is administered 1 to 26 (e.g., 1, 1½, 2, 2½, 3, 3½, 4, 4½, 5, 5½, 6, 6½, 7, 7½, 8, 8½, 9, 9½, 10, 10½, 11, 11½, 12, 12½, 13, 13½, 14, 14½, 15, 15½, 16, 16½, 17, 17½, 18, 18½, 19, 19½, 20, 20½, 21, 21½, 22, 22½, 23, 23½, 24, 24½, 25, 25½, 26, 26½, or more) weeks after the immediately preceding dose. The phrase "the immediately preceding dose," as used herein, means, in a sequence of multiple administrations, the dose of antigen-binding molecule which is administered to a patient prior to the administration of the very next dose in the sequence with no intervening doses.

The methods according to this aspect of the invention may comprise administering to a patient any number of secondary and/or tertiary doses of an antigen-binding molecule (e.g., an anti-MUC16 antibody or a bispecific antigen-binding molecule that specifically binds MUC16 and CD3). For example, in certain embodiments, only a single secondary dose is administered to the patient. In other embodiments, two or more (e.g., 2, 3, 4, 5, 6, 7, 8, or more) secondary doses are administered to the patient. Likewise, in certain embodiments, only a single tertiary dose is administered to the patient. In other embodiments, two or more (e.g., 2, 3, 4, 5, 6, 7, 8, or more) tertiary doses are administered to the patient.

In embodiments involving multiple secondary doses, each secondary dose may be administered at the same frequency as the other secondary doses. For example, each secondary dose may be administered to the patient 1 to 2 weeks after the immediately preceding dose. Similarly, in embodiments involving multiple tertiary doses, each tertiary dose may be administered at the same frequency as the other tertiary doses. For example, each tertiary dose may be administered to the patient 2 to 4 weeks after the immediately preceding dose. Alternatively, the frequency at which the secondary and/or tertiary doses are administered to a patient can vary over the course of the treatment regimen. The frequency of administration may also be adjusted during the course of treatment by a physician depending on the needs of the individual patient following clinical examination.

Diagnostic Uses of the Antibodies

The anti-MUC16 antibodies of the present invention may also be used to detect and/or measure MUC16, or MUC16-expressing cells in a sample, e.g., a biological sample for diagnostic purposes. For example, an anti-MUC16 antibody, or fragment thereof, may be used to diagnose a condition or disease characterized by aberrant expression (e.g., over-expression, under-expression, lack of expression, etc.) of MUC16. Exemplary diagnostic assays for MUC16 may comprise, e.g., contacting a sample, obtained from a patient, with an anti-MUC16 antibody of the invention, wherein the anti-MUC16 antibody is labeled with a detectable label or reporter molecule. Alternatively, an unlabeled anti-MUC16 antibody can be used in diagnostic applications in combination with a secondary antibody which is itself detectably labeled. The detectable label or reporter molecule can be a radioisotope, such as $^{3}H$, $^{14}C$, $^{32}P$, $^{35}S$, or $^{125}I$; a fluorescent or chemiluminescent moiety such as fluorescein isothiocyanate, or rhodamine; or an enzyme such as alkaline phosphatase, beta-galactosidase, horseradish peroxidase, or luciferase. Another exemplary diagnostic use of the anti-MUC16 antibodies of the invention includes $^{89}$Zr-labeled, such as $^{89}$Zr-desferrioxamine-labeled, antibody for the purpose of noninvasive identification and tracking of tumor cells in a subject (e.g. positron emission tomography (PET) imaging). (See, e.g., Tavare, R. et al. Cancer Res. 2016 Jan. 1; 76(1):73-82; and Azad, B B. et al. Oncotarget. 2016 Mar. 15; 7(11):12344-58.) Specific exemplary assays that can be used to detect or measure MUC16 in a sample include enzyme-linked immunosorbent assay (ELISA), radioimmunoassay (RIA), and fluorescence-activated cell sorting (FACS).

Samples that can be used in MUC16 diagnostic assays according to the present invention include any tissue or fluid sample obtainable from a patient which contains detectable quantities of MUC16 protein, or fragments thereof, under normal or pathological conditions. Generally, levels of MUC16 in a particular sample obtained from a healthy patient (e.g., a patient not afflicted with a disease or condition associated with abnormal MUC16 levels or activity) will be measured to initially establish a baseline, or standard, level of MUC16. This baseline level of MUC16 can then be compared against the levels of MUC16 measured in samples obtained from individuals suspected of having a MUC16 related disease (e.g., a tumor containing MUC16-expressing cells) or condition. Examples of tissue or fluid samples include, but are not limited to plasma, serum, ascites, ovary, uterus, cervix, liver, bladder, pancreas, stomach, small or large intestine, gall bladder, breast, lung, kidney, salivary, and lacrimal glands, or any epithelioid malignancy thereof. Additional examples of tissue or fluid samples include, but are not limited to papillary serous carcinoma of the cervix, adenocarcinoma of the endometrium, clear cell adenocarcinoma of the bladder, seminal vesicle carcinoma, gastric carcinoma, colorectal adenocarcinoma and epithelioid mesothelioma. It is envisioned that any fluid or tissue sample which contains detectable quantities of MUC16 protein, or fragments thereof, may be subjected to the detection methods described herein. The described methods may be used to monitor the development and progression of malignant diseases, or to distinguish between normal and disease conditions. As such, the described methods may be used to detect or monitor cancers, such as ovarian cancer, bladder cancer, breast cancer, pancreatic cancer, non-small-cell lung cancer, intrahepatic cholangiocarcinoma-mass forming type, adenocarcinoma of the uterine cervix, and adenocarcinoma of the gastric tract.

EXAMPLES

The following examples are put forth so as to provide those of ordinary skill in the art with a complete disclosure and description of how to make and use the methods and compositions of the invention, and are not intended to limit the scope of what the inventors regard as their invention. Efforts have been made to ensure accuracy with respect to numbers used (e.g., amounts, temperature, etc.) but some experimental errors and deviations should be accounted for. Unless indicated otherwise, parts are parts by weight, molecular weight is average molecular weight, temperature is in degrees Centigrade, and pressure is at or near atmospheric.

Example 1: Generation of Anti-MUC16 Antibodies

Anti-MUC16 antibodies were obtained by immunizing a genetically modified mouse with a human MUC16 antigen or by immunizing an engineered mouse comprising DNA encoding human immunoglobulin heavy and kappa light chain variable regions with a human MUC16 antigen.

Genetically modified mice were immunized with hMUC16.nub (a truncated format encompassing the last five SEA domains of Mucin-16 (SEQ ID: 1902)), or immunized with an hMUC16-expressing cell line, such as OVCAR-3 cells. SEQ ID NO: 1902 contains residues 13810-14451 of SEQ ID NO: 1899, as well as C-terminal tags. Following immunization, splenocytes were harvested from each mouse and either (1) fused with mouse myeloma cells to preserve their viability and form hybridoma cells and screened for MUC16 specificity, or (2) B-cell sorted (as described in US 2007/0280945A1) using a human MUC16 fragment as the sorting reagent that binds and identifies reactive antibodies (antigen-positive B cells).

Chimeric antibodies to MUC16 were initially isolated having a human variable region and a mouse constant region. The antibodies were characterized and selected for desirable characteristics, including affinity, selectivity, etc. If necessary, mouse constant regions were replaced with a desired human constant region, for example wild-type or modified IgG1 or IgG4 constant region, to generate a fully human anti-MUC16 antibody. While the constant region selected may vary according to specific use, high affinity antigen-binding and target specificity characteristics reside in the variable region. The antibody name designations such as H1H8755P and H1M7129N denote fully human antibodies "H1H" or chimeric human variable/mouse constant region antibodies "H1M". Antibodies identified by the hybridoma method are indicated with antibody ID numbers ending with "N" or "N2." Antibodies identified by the B-cell sorting method are indicated with antibody ID numbers ending with "P" or "P2".

Certain biological properties of the exemplary anti-MUC16 antibodies generated in accordance with the methods of this Example are described in detail in the Examples set forth below.

Heavy and Light Chain Variable Region Amino Acid and Nucleic Acid Sequences of Anti-MUC16 Antibodies Table 1 sets forth the amino acid sequence identifiers of the heavy and light chain variable regions and CDRs of selected anti-MUC16 antibodies of the invention. The corresponding nucleic acid sequence identifiers are set forth in Table 2.

TABLE 1

Amino Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| H1H8755P | 2 | 4 | 6 | 8 | 10 | 12 | 14 | 16 |
| H1H8767P | 18 | 20 | 22 | 24 | 26 | 28 | 30 | 32 |
| H1H8770P | 34 | 36 | 38 | 40 | 42 | 44 | 46 | 48 |
| H1H8783P | 50 | 52 | 54 | 56 | 58 | 60 | 62 | 64 |
| H1H8790P | 66 | 68 | 70 | 72 | 74 | 76 | 78 | 80 |
| H1H8794P | 82 | 84 | 86 | 88 | 90 | 92 | 94 | 96 |
| H1H8794P2 | 82 | 84 | 86 | 88 | 858 | 860 | 862 | 864 |
| H1H8799P | 98 | 100 | 102 | 104 | 106 | 108 | 110 | 112 |
| H1H8799P2 | 98 | 100 | 102 | 104 | 170 | 172 | 174 | 176 |
| H1H8804P | 114 | 116 | 118 | 120 | 122 | 124 | 126 | 128 |
| H1H8808P | 130 | 132 | 134 | 136 | 138 | 140 | 142 | 144 |
| H1H8810P | 146 | 148 | 150 | 152 | 154 | 156 | 158 | 160 |
| H1H8813P | 162 | 164 | 166 | 168 | 170 | 172 | 174 | 176 |
| H1M7129N | 178 | 180 | 182 | 184 | 186 | 188 | 190 | 192 |
| H1M7137N | 194 | 196 | 198 | 200 | 394 | 396 | 398 | 400 |
| H1M9519N | 202 | 204 | 206 | 208 | 210 | 212 | 214 | 216 |
| H1M9521N | 218 | 220 | 222 | 224 | 226 | 228 | 230 | 232 |
| H1M9528N | 234 | 236 | 238 | 240 | 242 | 244 | 246 | 248 |
| H2M7128N | 250 | 252 | 254 | 256 | 1936 | 1938 | 1940 | 1942 |
| H1M7130N | 1944 | 1946 | 1948 | 1950 | 1952 | 1954 | 1956 | 1958 |
| H2M7131N | 258 | 260 | 262 | 264 | 266 | 268 | 270 | 272 |
| H2M7133N | 274 | 276 | 278 | 280 | 1936 | 1938 | 1940 | 1942 |
| H2M7134N | 282 | 284 | 286 | 288 | 290 | 292 | 294 | 296 |
| H2M7135N | 298 | 300 | 302 | 304 | 306 | 308 | 310 | 312 |
| H2M7138N | 314 | 316 | 318 | 320 | 322 | 324 | 326 | 328 |
| H2M9538N | 330 | 332 | 334 | 336 | 338 | 340 | 342 | 344 |
| H3M9524N | 346 | 348 | 350 | 352 | 354 | 356 | 358 | 360 |
| H3M9525N | 362 | 364 | 366 | 368 | 370 | 372 | 374 | 376 |
| H3M9529N | 378 | 380 | 382 | 384 | 386 | 388 | 390 | 392 |

TABLE 2

Nucleic Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| H1H8755P | 1 | 3 | 5 | 7 | 9 | 11 | 13 | 15 |
| H1H8767P | 17 | 19 | 21 | 23 | 25 | 27 | 29 | 31 |
| H1H8770P | 33 | 35 | 37 | 39 | 41 | 43 | 45 | 47 |
| H1H8783P | 49 | 51 | 53 | 55 | 57 | 59 | 61 | 63 |
| H1H8790P | 65 | 67 | 69 | 71 | 73 | 75 | 77 | 79 |
| H1H8794P | 81 | 83 | 85 | 87 | 89 | 91 | 93 | 95 |
| H1H8794P2 | 81 | 83 | 85 | 87 | 857 | 859 | 861 | 863 |
| H1H8799P | 97 | 99 | 101 | 103 | 105 | 107 | 109 | 111 |
| H1H8799P2 | 97 | 99 | 101 | 103 | 169 | 171 | 173 | 175 |
| H1H8804P | 113 | 115 | 117 | 119 | 121 | 123 | 125 | 127 |
| H1H8808P | 129 | 131 | 133 | 135 | 137 | 139 | 141 | 143 |
| H1H8810P | 145 | 147 | 149 | 151 | 153 | 155 | 157 | 159 |
| H1H8813P | 161 | 163 | 165 | 167 | 169 | 171 | 173 | 175 |
| H1M7129N | 177 | 179 | 181 | 183 | 185 | 187 | 189 | 191 |
| H1M7137N | 193 | 195 | 197 | 199 | 393 | 395 | 397 | 399 |
| H1M9519N | 201 | 203 | 205 | 207 | 209 | 211 | 213 | 215 |
| H1M9521N | 217 | 219 | 221 | 223 | 225 | 227 | 229 | 231 |
| H1M9528N | 233 | 235 | 237 | 239 | 241 | 243 | 245 | 247 |
| H2M7128N | 249 | 251 | 253 | 255 | 1935 | 1937 | 1939 | 1941 |
| H1M7130N | 1943 | 1945 | 1947 | 1949 | 1951 | 1953 | 1955 | 1957 |
| H2M7131N | 257 | 259 | 261 | 263 | 265 | 267 | 269 | 271 |
| H2M7133N | 273 | 275 | 277 | 279 | 1935 | 1937 | 1939 | 1941 |
| H2M7134N | 281 | 283 | 285 | 287 | 289 | 291 | 293 | 295 |
| H2M7135N | 297 | 299 | 301 | 303 | 305 | 307 | 309 | 311 |
| H2M7138N | 313 | 315 | 317 | 319 | 321 | 323 | 325 | 327 |
| H2M9538N | 329 | 331 | 333 | 335 | 337 | 339 | 341 | 343 |
| H3M9524N | 345 | 347 | 349 | 351 | 353 | 355 | 357 | 359 |
| H3M9525N | 361 | 363 | 365 | 367 | 369 | 371 | 373 | 375 |
| H3M9529N | 377 | 379 | 381 | 383 | 385 | 387 | 389 | 391 |

Example 2: Anti-MUC16 Antibodies Bind Specifically to Endogenously Expressed hMUC16 on OVCAR-3 Cell Line The ability of anti-MUC16 antibodies to bind specifically to endogenously expressing MUC16 on the human ovarian carcinoma cell line (OVCAR-3) was evaluated via an electrochemiluminescence based detection assay (Meso Scale Discovery (MSD), Rockville, Md.). Briefly, OVCAR-3 and a control ovarian adenocarcinoma cell line, SK-OV-3, which has no detectable hMUC16 expression, were rinsed in 1×PBS supplemented with $Ca^{2+}/Mg^{2+}$ (Irvine Scientific, Santa Ana, Calif.) followed by incubation in Enzyme Free Cell Dissociation buffer (Millipore, Billerica, Mass.) for 10 min at 37° C. Detached cells were then washed once in 1×PBS supplemented with $Ca^{2+}/Mg^{2+}$ and counted (Cellometer Auto T4 cell counter, Nexcelom Bioscience, Lawrence, Mass.). Approximately $1.0 \times 10^4$ cells were plated in MULTI-ARRAY 96-well carbon electrode plates (MSD) and incubated for 1 h at 37° C. Nonspecific binding sites were then blocked by 2% BSA (w/v) in PBS for 1 h at room temperature. Next, serial dilutions of anti-MUC16 or control antibodies (0.85 μM-50 nM) and no-antibody buffer controls were added to the plate-bound cells and incubated for 1 h at room temperature (RT). Plates were then washed to remove the unbound antibodies using an AquaMax2000 plate washer (MDS Analytical Technologies, Sunnyvale, Calif.). Plate-bound antibodies were detected with a SULFO-TAG™-conjugated anti-human kappa light chain antibody (Regeneron) or a SULFO-TAG™-conjugated anti-mouse IgG antibody (Jackson Immunoresearch, West Grove, Pa.) for 1h at RT. Post-wash, plates were developed with Read Buffer (MSD) according to manufacturer's protocol and luminescent signals were recorded with a SECTOR Imager 6000 (MSD) instrument.

Luminescence intensity, measured in relative light units (RLU), for the two cell lines was recorded to indicate the binding intensity of each antibody. The ratio of signal detected with 1.9 nM or 16.7 nM anti-MUC16 antibody binding to OVCAR-3 vs. SK-OV-3 was reported as an indication of specificity and potency of binding (Table 3).

TABLE 3

Cell Binding Ratios of Anti-Muc16 Antibodies to Endogenously Expressing hMUC16 OVCAR-3 vs hMUC16-negative SK-OV-3 Cell Lines

| | Ratio: anti-MUC16 Binding OVCAR-3/SK-OV-3 | |
|---|---|---|
| Antibody ID | [Ab]: 1.9 nM | [Ab]: 16.7 nM |
| Hybridoma Anti-Muc16 Antibodies (H1M, H2M, H3M) | | |
| H2M7128N | 59 | 31 |
| H1M7129N | 68 | 19 |
| H2M7131N | 86 | 37 |
| H2M7133N | 69 | 33 |
| H2M7134N | 68 | 29 |
| H2M7135N | 30 | 5 |
| H1M7137N | 77 | 29 |
| H2M7138N | 82 | 50 |
| H3M7132N | 89 | 38 |
| H1M9519N | 109 | 78 |
| H1M9521N | 132 | 107 |
| H3M9524N | 81 | 57 |
| H3M9525N | 137 | 51 |
| H1M9528N | 153 | 120 |
| H3M9529N | 143 | 99 |
| H2M9538N | 89 | 26 |

TABLE 3-continued

Cell Binding Ratios of Anti-Muc16 Antibodies to
Endogenously Expressing hMUC16 OVCAR-3 vs
hMUC16-negative SK-OV-3 Cell Lines

| Antibody ID | Ratio: anti-MUC16 Binding OVCAR-3/SK-OV-3 | |
|---|---|---|
| | [Ab]: 1.9 nM | [Ab]: 16.7 nM |
| Human Fc anti-MUC16 Antibodies (H1H) | | |
| H1H8755P | 13 | 5 |
| H1H8767P | 4 | NS |
| H1H8770P | 9 | 3 |
| H1H8783P | 11 | 4 |
| H1H8790P | 8 | 3 |
| H1H8794P | 8 | 3 |
| H1H8794P2 | 5 | NS |
| H1H8799P | 10 | 4 |
| H1H8799P2 | 10 | 4 |
| H1H8804P | 8 | 3 |
| H1H8808P | 4 | NS |
| H1H8810P | 8 | 3 |
| H1H8813P | 11 | 5 |
| H1H9519N | 41 | 30 |
| H1H9521N | 30 | 28 |
| H1H9524N | 20 | 48 |
| H1H9525N | 4 | 21 |
| H1H9528N | 41 | 18 |
| H1H9529N | 109 | 74 |
| H1H9538N | 12 | 13 |
| Controls | | |
| mIgG1 Isotype Control Antibody | NS | NS |
| mIgG2a Isotype Control Antibody | NS | NS |
| hIgG1 Isotype Control Antibody | NS | NS |

NS = Non-Specific - ratio at 1.9 nM or 16.7 nM <2.5-fold.
Isotypes: H1H: hIgG1; H1M: mIgG1; H2M: mIgG2; H3M: mIgG3
Note:
variation in binding intensity ratios between the same antibody expressed with a mouse Fc and human Fc is due to the use of different SULFO-TAG secondary detect reagents.

As the results in Table 3 show, a majority of the anti-MUC16 antibodies of this invention bound specifically to OVCAR-3 at both high (16.7 nM) and low (1.9 nM) antibody concentrations. mIgG1, mIgG2a and hIgG1 Isotype Control antibodies showed no specific binding to either OVCAR-3 or the SK-OV-3 cell line. Additionally, evidence exists that the method is sensitive since several antibodies that did not exhibit binding to soluble monomeric human MUC16 protein in a surface plasmon resonance binding assay (see Example 4 hereinbelow) displayed specific binding to endogenous human MUC16 expressed on OVCAR-3 cells in this cell-based binding assay.

Example 3: Generation of Bispecific Antibodies that Bind Ovarian Cell-Specific (MUC16) and CD3

The present invention provides bispecific antigen-binding molecules that bind CD3 and MUC16; such bispecific antigen-binding molecules are also referred to herein as "anti-MUC16/anti-CD3 or anti-MUC16×CD3 bispecific molecules." The anti-MUC16 portion of the anti-MUC16/anti-CD3 bispecific molecule is useful for targeting tumor cells that express MUC16 (also known as CA-125), and the anti-CD3 portion of the bispecific molecule is useful for activating T-cells. The simultaneous binding of MUC16 on a tumor cell and CD3 on a T-cell facilitates directed killing (cell lysis) of the targeted tumor cell by the activated T-cell.

Bispecific antibodies comprising an anti-MUC16-specific binding domain and an anti-CD3-specific binding domain were constructed using standard methodologies, wherein the anti-MUC16 antigen binding domain and the anti-CD3 antigen binding domain each comprise different, distinct HCVRs paired with a common LCVR. In exemplified bispecific antibodies, the molecules were constructed utilizing a heavy chain from an anti-CD3 antibody, a heavy chain from an anti-MUC16 antibody and a common light chain from the anti-MUC16 antibody. In other instances, the bispecific antibodies may be constructed utilizing a heavy chain from an anti-CD3 antibody, a heavy chain from an anti-MUC16 antibody and a light chain from an anti-CD3 antibody or an antibody light chain known to be promiscuous or pair effectively with a variety of heavy chain arms.

The bispecific antibodies described in the following examples consist of anti-CD3 binding arms having varying binding affinities to human soluble heterodimeric hCD3ε/δ protein (as described in Example 15 herein); and human MUC16 (see Examples 1-2 above). Exemplified bispecific antibodies were manufactured having an IgG1 Fc domain (BSMUC16/CD3-001, -002, -003, and -004) or a modified (chimeric) IgG4 Fc domain (BSMUC16/CD3-005) as set forth in US Patent Application Publication No. US20140243504A1, published on Aug. 28, 2014.

A summary of the component parts of the antigen-binding domains of the various anti-MUC16×CD3 bispecific antibodies constructed is set forth in Table 4.

TABLE 4

Summary of Component Parts of Selected Anti-MUC16×CD3 Bispecific Antibodies

| Bispecific Antibody Identifier | Anti-MUC16 Antigen-Binding Domain Heavy Chain Variable Region | Anti-CD3 Antigen-Binding Domain Heavy Chain Variable Region | Common Light Chain Variable Region |
|---|---|---|---|
| BSMUC16/CD3-001 | H1H8767P (SEQ ID NO: 18) | CD3-VH-G (SEQ ID NO: 1730) | H1H8767P (SEQ ID NO: 26) |
| BSMUC16/CD3-002 | H1H8767P (SEQ ID NO: 18) | CD3-VH-G5 (SEQ ID NO: 1762) | H1H8767P (SEQ ID NO: 26) |
| BSMUC16/CD3-003 | H1H8767P (SEQ ID NO: 18) | CD3-VH-G9 (SEQ ID NO: 1778) | H1H8767P (SEQ ID NO: 26) |
| BSMUC16/CD3-004 | H1H8767P (SEQ ID NO: 18) | CD3-VH-G10 (SEQ ID NO: 1786) | H1H8767P (SEQ ID NO: 26) |
| BSMUC16/CD3-005 | H1H8767P (SEQ ID NO: 18) | CD3-VH-G20 (SEQ ID NO: 1866) | H1H8767P (SEQ ID NO: 26) |

The light chains listed in Table 4 were common to both the CD3 and MUC16 targeting arms of the bispecific antibodies. Tables 1 and 2 set out amino acid and nucleic acid sequence identifiers, respectively, for the various heavy chain variable regions, and their corresponding CDRs, of the anti-MUC16 arms of the bispecific antibodies of this Example. Table 22 and 23 set out amino acid and nucleic acid sequence identifiers, respectively, for the various heavy chain variable regions, and their corresponding CDRs, of the anti-CD3 arms of the bispecific antibodies of this Example.

Example 4: Surface Plasmon Resonance Derived Binding Affinities and Kinetic Constants of Human Monoclonal Anti-MUC16 Monospecific and Anti-MUC16×CD3 Bispecific Antibodies Binding affinities and kinetic constants of human anti-MUC16 antibodies were determined via real-time surface plasmon resonance (SPR; Biacore 4000 or Biacore T-200, GE Healthcare Life Sciences, Pittsburgh, Pa.) at 25° C. The anti-MUC16 antibodies tested in this example were bivalent monospecific binders to MUC16 (expressed with a hIgG1 (H1H), mIgG1 (H1M), mIgG2 (H2M) or mIgG3 (H3M) constant region) or bispecific antibodies comprised of an anti-MUC16 binding domain and an anti-CD3 binding domain. Antibodies were captured onto a CM4 or CM5 Biacore sensor surface (GE Healthcare Life Sciences) derivatized via amine coupling with a monoclonal anti-human Fc antibody (GE, # BR-1008-39) or a monoclonal goat anti-mouse Fc antibody (GE, # BR-1008-38). Various concentrations of soluble monomeric human MUC16, in a truncated format encompassing the last five SEA domains of Mucin-16 (hMUC16.mmh, or MUC16 "nub", SEQ ID: 1902) were injected over the anti-MUC16-antibody captured surface at a flow rate of 50 uL/minute (Biacore T-200) or 30 uL/minute (Biacore 4000). Antibody-reagent association was monitored for 4 min and the dissociation was monitored for 6-10 min. All binding studies were performed in HBS-ET buffer (0.01M HEPES pH 7.4, 0.15M NaCl, 0.05% v/v Surfactant P20).

Kinetic association ($k_a$) and dissociation ($k_d$) rate constants were determined by fitting the real-time sensorgrams to a 1:1 binding model using Scrubber 2.0c curve fitting software. Binding dissociation equilibrium constants ($K_D$) and dissociative half-lives (t ½) were calculated from the kinetic rate constants as:

$$K_D(M) = \frac{kd}{ka}, \text{ and } t1/2(\min) = \frac{\ln(2)}{60 * kd}$$

Binding kinetic parameters for the monospecific anti-MUC16 antibodies to a monomeric human MUC16 protein fragment are shown below in Tables 5A and 5B. Binding kinetic parameters for the anti-MUC16/anti-CD3 bispecific antibodies to monomeric human MUC16 protein are shown below in Table 6.

TABLE 5A

Biacore binding affinities of Hybridoma Anti-MUC16 antibodies (H1M, H2M and H3M) to hMUC16 fragment at 25° C.

| Antibody ID | ka (1/Ms) | kd (1/s) | KD (M) | t ½ (min) |
|---|---|---|---|---|
| H2M7128N | 1.89E+05 | 6.40E−04 | 3.39E−09 | 18 |
| H1M7129N | 5.31E+04 | 1.04E−04 | 1.97E−09 | 111 |
| H2M7131N | 6.47E+04 | 1.62E−04 | 2.51E−09 | 71 |
| H3M7132N | 2.57E+04 | 1.96E−04 | 7.62E−09 | 59 |
| H2M7133N | 1.67E+05 | 3.77E−04 | 2.26E−09 | 31 |
| H2M7134N | 6.55E+04 | 1.62E−04 | 2.47E−09 | 71 |
| H2M7135N | 5.10E+04 | 2.18E−04 | 4.27E−09 | 53 |
| H1M7137N | 5.30E+04 | 9.09E−05 | 1.72E−09 | 127 |
| H2M7138N | 7.41E+04 | 9.25E−05 | 1.25E−09 | 125 |
| H1M9519N | NB | NB | NB | NB |
| H1M9521N | NB | NB | NB | NB |
| H3M9524N | NB | NB | NB | NB |
| H3M9525N | NB | NB | NB | NB |
| H1M9528N | NB | NB | NB | NB |
| H3M9529N | NB | NB | NB | NB |

NB: No binding

TABLE 5B

Biacore binding affinities of Human Fc anti-MUC16 antibodies (H1H) to hMUC16 fragment at 25° C.

| Antibody ID | ka (1/Ms) | kd (1/s) | KD (M) | $t_{1/2}$ (min) |
|---|---|---|---|---|
| H1H8755P | 5.22E+05 | 1.49E−04 | 2.86E−10 | 77 |
| H1H8767P | 1.17E+05 | 4.18E−04 | 3.58E−09 | 28 |
| H1H8770P | 2.47E+05 | 3.08E−04 | 1.25E−09 | 38 |
| H1H8783P | 1.74E+05 | 1.07E−04 | 6.14E−10 | 108 |
| H1H8790P | 1.01E+05 | 7.61E−04 | 7.53E−09 | 15 |
| H1H8794P | 3.62E+05 | 2.79E−04 | 7.71E−10 | 41 |
| H1H8799P | 7.90E+04 | 3.66E−04 | 4.63E−09 | 32 |
| H1H8799P2 | 7.58E+04 | 3.73E−04 | 4.92E−09 | 31 |
| H1H8804P | 4.94E+04 | 6.07E−04 | 1.23E−08 | 19 |
| H1H8808P | 4.12E+03 | 2.16E−04 | 5.24E−08 | 54 |
| H1H8810P | 5.77E+04 | 3.16E−04 | 5.48E−09 | 37 |
| H1H8813P | 5.32E+04 | 2.32E−04 | 4.35E−09 | 50 |

TABLE 6

Biacore binding affinities of anti-MUC16/anti-CD3 Bispecific Antibodies to hMUC16 fragment at 25° C

| Bispecific Antibody Identifier | ka (1/Ms) | kd (1/s) | KD (M) | t ½ (min) |
|---|---|---|---|---|
| BSMUC16/CD3-001 | 9.48E+04 | 5.86E−04 | 6.18E−09 | 20 |
| BSMUC16/CD3-005 | 9.41E+04 | 5.64E−04 | 6.00E−09 | 21 |

As the results show, a majority of the anti-MUC16 antibodies of this invention bound to the soluble human MUC16 protein, some displaying sub-nanomolar affinity. Several antibodies (H1M9519N, H1M9521N, H3M9524N, H3M9525N, H1M9528N, H3M9529N) displayed no binding to the truncated format encompassing the last five SEA domains via surface plasmon resonance, however, displayed specific binding to endogenous human MUC16 expressed on OVCAR-3 cells in a cell-based binding assay. Anti-MUC16×CD3 bispecific antibodies of this invention also bound to soluble truncated human MUC16 protein exhibiting nanomolar affinity in this assay.

Example 5: Additional Binding, T-Cell Activation and Cytotoxicity Properties of Exemplified Bispecific Antibodies In this example, the ability of MUC16×CD3 bispecific antibodies to bind to human CD3-expressing (human T cell) cell lines, compared to binding to target-specific (MUC16-specific) cell lines, via FACS was determined. Additionally, the ability of these bispecific antibodies to activate to target-specific (MUC16-specific) cell lines was also compared in a similar assay.

Binding Titration of Exemplified Bispecific Antibodies as Measured by FACS Analysis A. Briefly, flow cytometric analysis (i.e. fluorescence-activated cell sorting, or FACS) was utilized to determine binding of bispecific antibodies to Jurkat cells or cells expressing human MUC16, followed by detection with a phycoerythrin (PE)-labeled or APC-labeled anti-human IgG antibody. Briefly, 2×10⁵ cells/well were incubated for 30 minutes at 4° C. with a serial dilution ranging from 1.33E-07M to 8.03E-12M of each test antibody or isotype control (antibody of same isotype that binds a different antigen with no cross-reactivity to MUC16 or CD3). After incubation, the cells were washed twice with cold PBS containing 1% filtered FBS and a PE-conjugated or APC-conjugated anti-human secondary antibody was added to the cells and incubated for an additional 30 minutes. Wells containing no antibody or secondary only were also used as controls. After incubation, cells were washed, re-suspended in 200 µL cold PBS containing 1% filtered FBS and analyzed by flow cytometry on a BD FACS Canto II. See Table 7A.

Figure 11A:
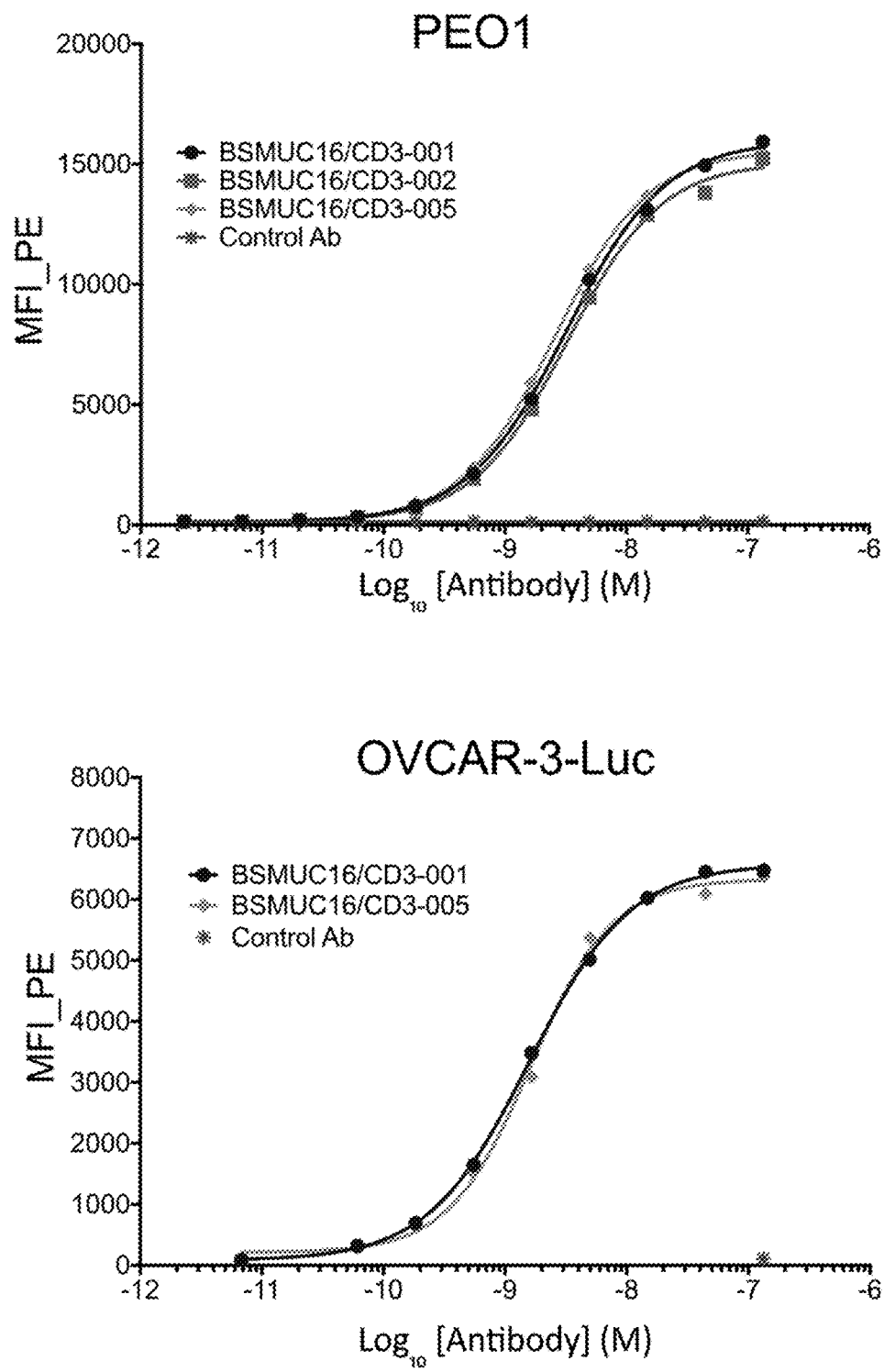
FIGS. 11A-11C illustrate the results of flow cytometric analysis (or FACS) of the binding of select bispecific antibodies to PEO-1, OVCAR3-Luc, Jurkat cells, and cynomolgus T cells. The titration analysis was done by testing a range of serial dilutions of each antibody: either MUC16×CD3 bispecific antibodies BSMUC16/CD3-001, BSMUC16/CD3-002, or BSMUC16/CD3-003, or a first or second isotype control antibody (having no cross-reactivity to CD3 or MUC16).
Figure 11B:
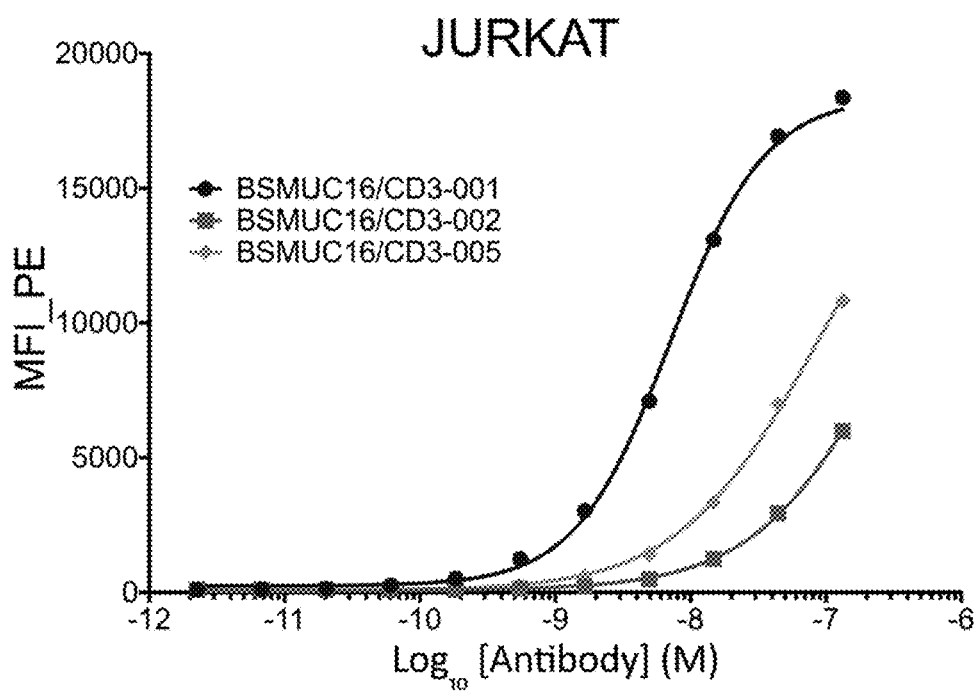
Figure 11B:
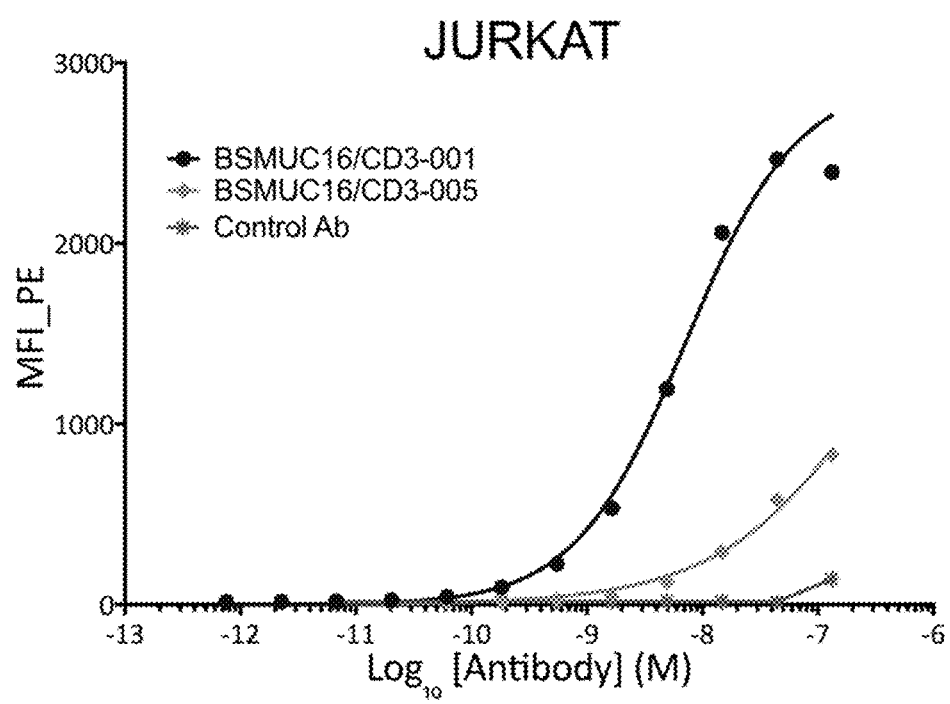
Figure 11C:
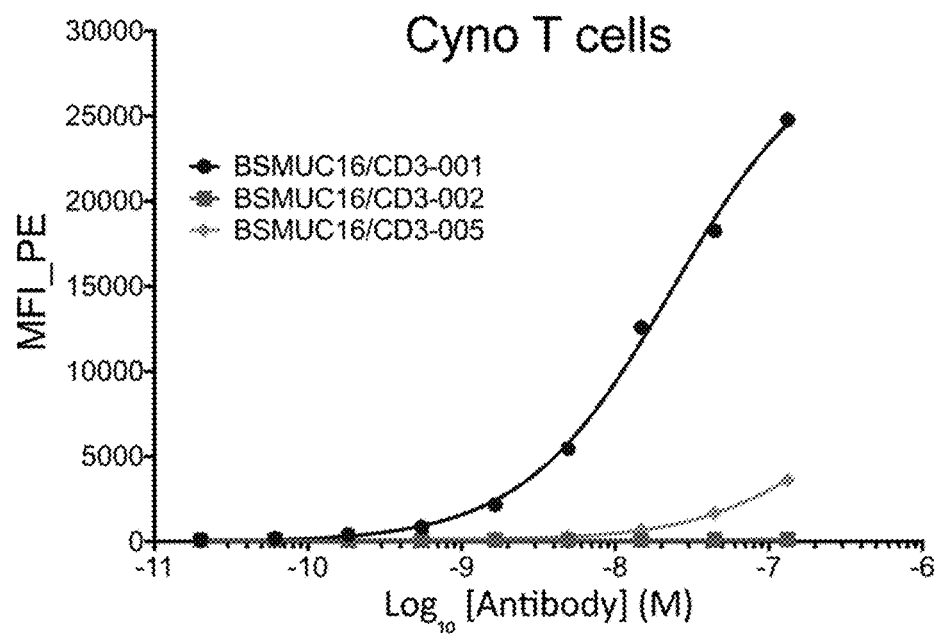
Figure 11C:
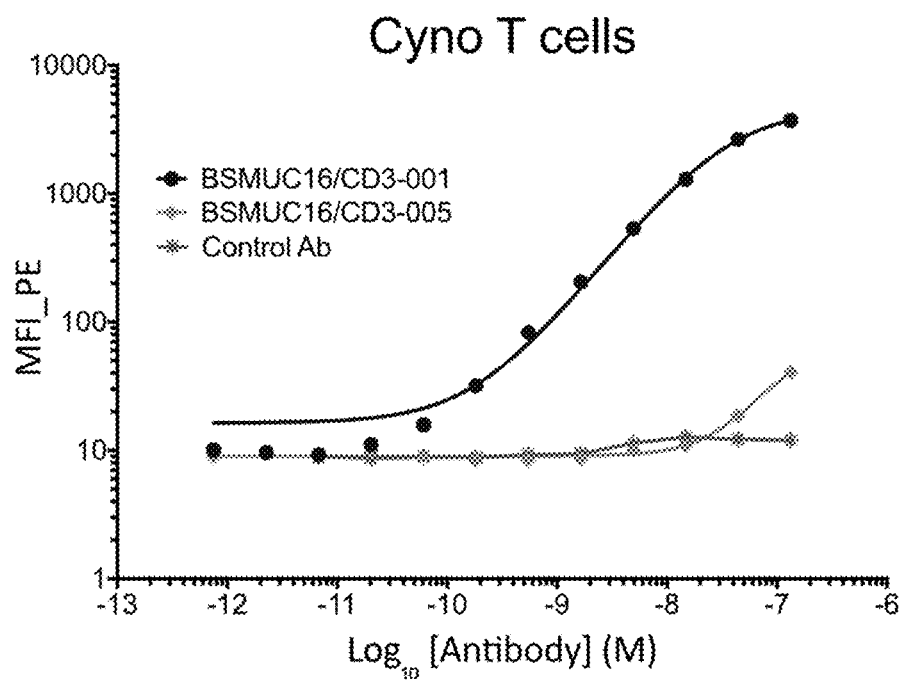

B. In separate experiments with analogous conditions to that described above, flow cytometric analysis (or FACS) was utilized to determine binding of select bispecific antibodies to Jurkat cells, PEO-1, OVCAR3-Luc and cynomolgus T cells. For the titration analysis, serial dilution of selected MUC16×CD3 bispecific antibodies, a first isotype control antibody (a human chimeric IgG4 antibody that binds an irrelevant human antigen with no cross-reactivity to human or cynomolgus CD3) and a second isotype control antibody (a human chimeric IgG4 antibody that binds an irrelevant human antigen with no cross-reactivity to human MUC16), ranging from 66.6 nM to 0.001 nM. See Table 7B and FIGS. 11A-11C.

For FACS analysis, cells were gated by forward scatter height vs. forward scatter area for single events selection, followed by side and forward scatters. The EC50 for cell binding titration was determined using PRISM™ software (GraphPad Software, Inc., La Jolla, Calif.). Values were calculated using 4-parameter non-linear regression analysis. (Liu, J., et al. 2005, *Biotechnol Letters* 27:1821-1827). The EC50 value represents the concentration of the tested antibody where 50% of its maximal binding is observed.

TABLE 7A

FACS Binding on CD3 and MUC16-Specific Cell lines

| Bispecific Antibody Identifier | Anti-CD3 Binding Arm | FACS binding titration $EC_{50}$ [M] | |
|---|---|---|---|
| | | Jurkat | OVCAR3 (MUC16+) |
| BSMUC16/CD3-001 | CD3-VH-G | 3.21E−09 | 1.20E−09 |
| BSMUC16/CD3-002 | CD3-VH-G5 | Very weak | 2.69E−09 |

TABLE 7B

FACS Binding on CD3 and MUC16-Specific Cell lines

| Bispecific Antibody Identifier | Anti-CD3 Binding Arm | FACS binding titration $EC_{50}$ [M] | | | |
|---|---|---|---|---|---|
| | | PEO-1 (MUC16+) | OVCAR3-Luc (MUC16+) | Jurkat | Cynomolgus T cells |
| BSMUC16/CD3-001 | CD3-VH-G | 3.02E−09 | 1.32E−09 | 6.44E−09 | 1.56E−08 |
| BSMUC16/CD3-002 | CD3-VH-G5 | 3.13E−09 | Not tested | 3.01E−07 | No Binding |
| BSMUC16/CD3-005 | CD3-VH-G20 | 2.63E−09 | 1.47E−09 | 6.26E−08 | 1.17E−06 |

As shown in Tables 7A and 7B, the CD3 binding arms of each MUC16 bispecific antibody displayed a range of cell binding to human and monkey CD3 expressing T cells (e.g. from 3.2 nM $EC_{50}$ to very weak binding). BSMUC16/CD3-001 bispecific antibody showed high measurement of binding to CD3-expressing cells (i.e. <7 nM) while the BSMUC16/CD3-002 bispecific antibody showed weak-to-no binding to human and monkey CD3-expressing cells. Non-measurable binding, or no measurable binding, in the FACS assay or equivalent assay refers to a binding interaction between the antibody and its target antigen which is beyond the detection limit of the assay (e.g. at or above 1 µM). The tested bispecific antibodies displayed similar cell binding on MUC16-expressing cell lines, confirming that bispecific pairing with individual CD3 arms exhibiting high or weak (or no measurable) interactions with CD3 did not affect or diminish tumor target-specific binding (MUC16-specific binding was less than or equal to 3 nM (high binding) in these examples. The first control antibody did not bind to CD3+ cells, and the second control antibody did not bind to MUC16+ cells. See also FIGS. 11A-11C.

Antibodies exhibiting weak-to-no detectable binding to human CD3 are still considered advantageous for avidity-driven bispecific pairing, and were further tested for cytotoxicity in in vitro (see below) and in vivo assays (Example 8).

T-Cell Activation and Tumor-Specific Cytotoxicity Exhibited by Bispecific Antibodies as Measured in Vitro A. The specific killing of MUC16-expressing tumor target cells in the presence of CD3-based bispecific antibodies was monitored via flow cytometry. As reported previously, the bispecific antibodies displayed differential binding abilities to CD3 protein and CD3-expressing cell lines (i.e. very weak or strong binding). These same bispecific antibodies were tested for the ability to induce naïve human T-cells to re-direct killing toward target-expressing cells.

Briefly, MUC16-expressing (OVCAR3) cell lines were labeled with 1 µM of the fluorescent tracking dye Violet Cell Tracker. After labeling, cells were plated overnight at 37° C. Separately, human PBMCs were plated in supplemented RPMI media at $1 \times 10^6$ cells/mL and incubated overnight at 37° C. in order to enrich for lymphocytes by depleting adherent macrophages, dendritic cells, and some monocytes. The next day, target cells were co-incubated with adherent cell-depleted unstimulated PBMC (Effector/Target cell 4:1 ratio) and a serial dilution of relevant bispecific antibodies or Isotype control (concentration range: 66.7 nM to 0.25 µM) for 48 hours at 37° C. Cells were removed from cell culture plates using an enzyme-free cell dissociation buffer, and analyzed by FACS. See results represented in Table 8A.

Figure 12A:
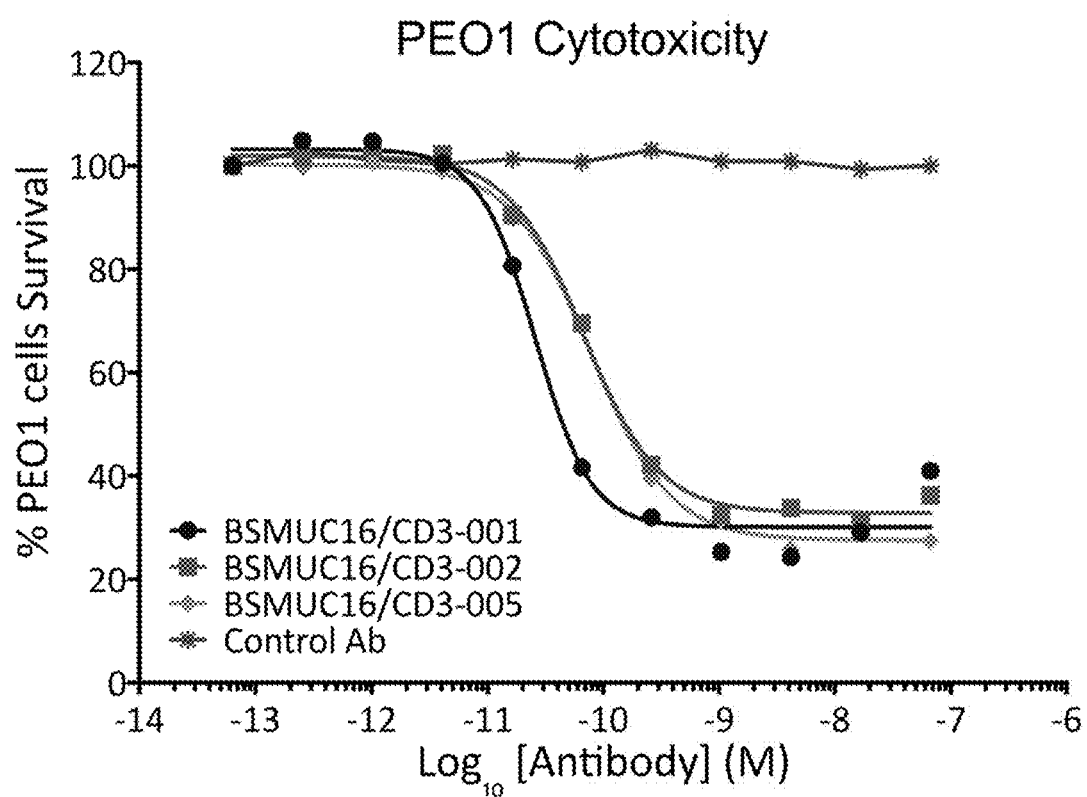
FIGS. 12A and 12B depict examples of PEO-1 (FIG. 12A) or OVCAR3-Luc (FIG. 12B) cell killing in a 48 hour cytotoxicity assay following anti-MUC16×anti-CD3 treatment in the presence of human PBMCs.
Figure 12B:
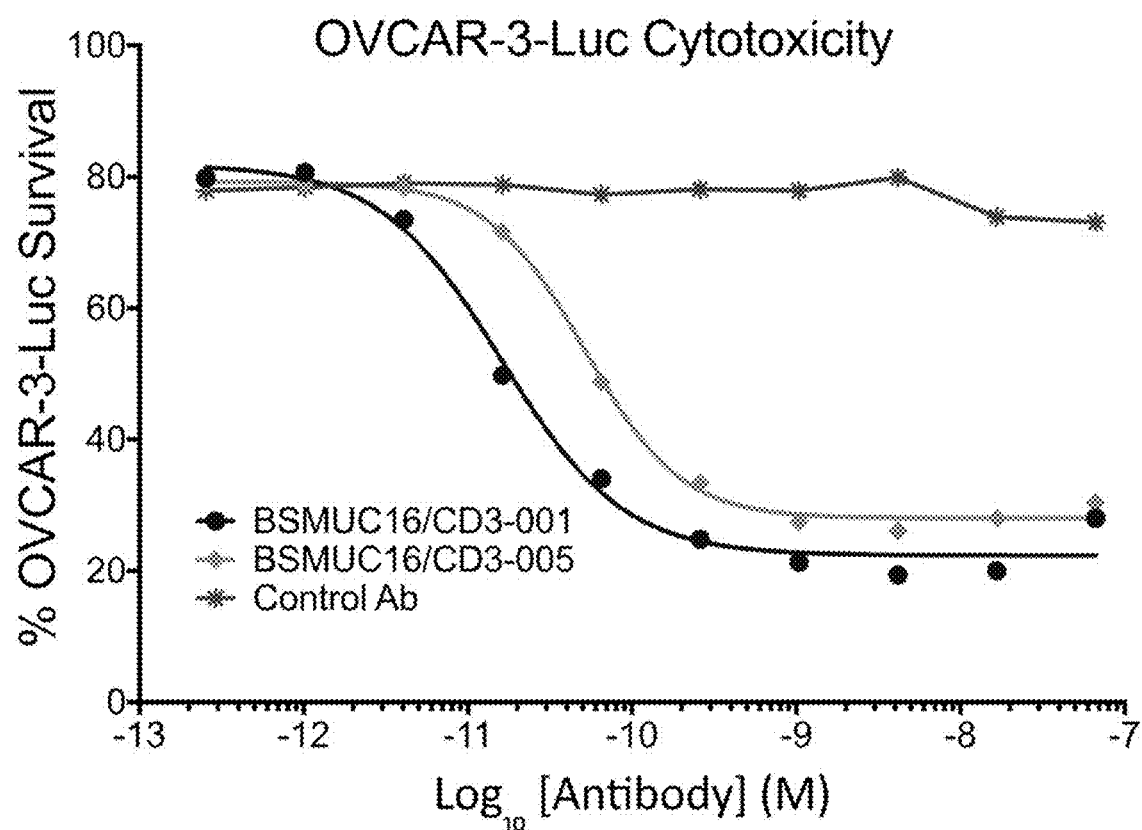

B. In analogous studies, MUC16-expressing (PEO-1 or OVCAR3-Luc) cell lines were labeled, plated and incubated overnight as described. Serial dilutions of MUC16×CD3 bispecific antibodies or isotype control were co-incubated. See results depicted in Tables 8B and 8C, and FIGS. 12A-12B.

For FACS analysis, cells were stained with a dead/live far red cell tracker (Invitrogen). $5 \times 10^5$ counting beads were added to each well immediately before FACS analysis. $1 \times 10^4$ beads were collected for each sample. For the assessment of specificity of killing, cells were gated on live Violet labeled populations. Percent of live population was recorded and used for the calculation of normalized survival.

T cell activation was assessed by incubating cells with directly conjugated antibodies to CD2, CD69 and/or CD25, and by reporting the percent of early activated (CD69+) T cells and/or late activated (CD25+) T cells out of total T cells (CD2+).

As the results in Tables 8A-8C show, depletion of MUC16-expressing cells was observed with anti-MUC16× CD3 bispecifics. All of the tested bispecific antibodies activated and directed human T cells to deplete the target cells with $EC_{50}$s in picomolar range. Additionally, the observed target-cell lysis (depletion) was associated with an up-regulation of CD69 (or CD25) on CD2+ T cells, also with picomolar (pM) $EC_{50}$s.

Importantly, the results of this example also demonstrate that a bispecific antibody constructed with a CD3 binding arm that displayed weak-to-no measurable binding to CD3 protein or CD3-expressing cells (i.e. CD3-VH-G5) still retained the ability to activate T-cells and exhibited potent cytotoxicity of tumor antigen-expressing cells.

HDX-MS experiments were performed on an integrated Waters HDX/MS platform, consisting of a Leaptec HDX PAL system for deuterium labeling, a Waters Acquity M-Class (Auxiliary solvent manager) for sample digestion and loading, a Waters Acquity M-Class (pBinary solvent manager) for the analytical column gradient, and a Synapt G2-Si mass spectrometer for peptic peptide mass measurement.

The labeling solution was prepared in 10 mM PBS buffer in $D_2O$ at pD 7.0. For deuterium labeling, 3.8 μL of hMUC16.nub (12 pmol/μL) or hMUC16.nub premixed with the anti-MUC16 antibody H4sH8767P, H1H8794P2, or H1H8799P2 in a 2:1 molar ratio was incubated with 56.2 μL. $D_2O$ labeling solution for various time-points (e.g.: undeuterated control=0 sec; deuterium labeling: 1 min and 20 min). The deuteration was quenched by transferring 50 μL sample to 50 μL pre-chilled quench buffer (0.2 M TCEP, 6

TABLE 8A

Cytotoxicity and T-cell activation properties of selected MUC16 × CD3 Bispecific Antibodies

| Bispecific Antibody Identifier | Anti-CD3 Binding Arm | OVCAR3 cell depletion $EC_{50}$ [M] | T cell activation (CD69 upregulation) $EC_{50}$ [M] |
|---|---|---|---|
| BSMUC16/CD3-001 | CD3-VH-G | 2.24E−11 | 5.88E−12 |
| BSMUC16/CD3-002 | CD3-VH-G5 | 3.06E−11 | 1.01E−11 |

TABLE 8B

Cytotoxicity and T-cell activation properties of selected MUC16 × CD3 Bispecific Antibodies

| Bispecific Antibody Identifier | PEO-1 cell depletion EC50 [M] | T cells activation (CD69 upregulation) EC50 [M] | T cells activation (CD25 upregulation) EC50 [M] |
|---|---|---|---|
| BSMUC16/CD3-001 | 2.56E−11 | 8.34E−12 | 3.90E−11 |
| BSMUC16/CD3-002 | 6.75E−11 | 1.34E−11 | 8.89E−11 |
| BSMUC16/CD3-005 | 7.74E−11 | 1.72E−11 | 1.06E−10 |

TABLE 8C

Cytotoxicity and T-cell activation properties of selected MUC16 × CD3 Bispecific Antibodies

| Bispecific Antibody Identifier | OVCAR3-Luc cell depletion EC50 [M] | T cells activation (CD69 upregulation) EC50 [M] | T cells activation (CD25 upregulation) EC50 [M] |
|---|---|---|---|
| BSMUC16/CD3-001 | 1.54E−11 | 2.98E−12 | 3.06E−11 |
| BSMUC16/CD3-005 | 5.16E−11 | 1.54E−11 | 1.17E−10 |

Example 6: Hydrogen/Deuterium (H/D) Exchange Based Epitope Mapping of Anti-Muc16 Antibodies H4sH8767P, H1H8794P2, and H1H8799P2 Binding to a Portion of the C-Term Domain of hMUC16

Experiments were conducted to determine the MUC16 amino acid residues within the C-terminal five SEA domains (SEQ ID No: 1902, hereafter referred to as hMUC16.nub), with which the anti-MUC16 antibodies H4sH8767P, H1H8794P2, and H1H8799P2 interact. For this purpose, Hydrogen/Deuterium (H/D) Exchange epitope mapping with mass spectrometry (HDX-MS) was utilized. A general description of the H/D exchange method is set forth in Ehring (1999) *Analytical Biochemistry* 267(2):252-259; and Engen and Smith (2001) *Anal. Chem.* 73:256A-265A.

M guanidine chloride in 100 mM phosphate buffer, pH 2.5) and the mixed sample was incubated at 1.0° C. for two minutes. The quenched sample was then injected into a Waters HDX Manager for online pepsin/protease XIII digestion. The digested peptides were trapped onto an ACQUITY UPLC BEH C18 1.7-μm, 2.1×5 mm VanGuard pre-column at 0° C. and eluted to an analytical column ACQUITY UPLC BEH C18 (1.7-μm, 1.0×50 mm) for a 9-minute gradient separation of 5%-40% B (mobile phase A: 0.1% formic acid in water, mobile phase B: 0.1% formic acid in acetonitrile). The mass spectrometer used a cone voltage of 37V, a scan time of 0.5 s, and mass/charge range of 50-1700 Th.

For the identification of the peptide residues of hMUC16.nub with which H4sH8767P, H1H8794P2, and H1H8799P2 interact, LC-MS$^E$ data from the undeuterated sample were processed and searched against a database that included sequences for hMUC16.nub, pepsin and a randomized sequence using Waters ProteinLynx Global Server (PLGS) software. The identified peptides were imported to DynamX software and filtered by two criteria: 1) minimum products per amino acid: 0.25 and 2) replication file threshold: 2. DynamX software then automatically determined deuterium uptake of each peptide based on retention time and high mass accuracy (<10 ppm) across multiple time points with 3 replicates at each time.

Using the online pepsin/protease XIII column coupled with MS$^E$ data acquisition, a total of 109 peptides from hMUC16.nub were identified in the absence or presence of the H4sH8767P, representing 64% sequence coverage. Six peptides had significantly reduced deuteration uptake (centroid delta values >0.5 daltons from at least one time point with p-values <0.05) when bound to H4sH8767P and are illustrated in the Table 9A. The recorded peptide mass corresponds to the average value of the centroid MH$^+$ mass from three replicates. These peptides, corresponding to amino acids 428-434, 453-467, and 474-481 of hMuc16.nub, had slower deuteration rates when bound to H4sH8767P. These identified residues also correspond to residues 14237-14243, 14262-14276, and 14283-14290 of hMUC16 as defined by the Uniprot entry Q8WXI7 (MUC16_HUMAN), SEQ ID NO:1899.

TABLE 9A hMUC16.nub Peptides with Altered Deuteration Rates Upon Binding H4sH8767P

| Residues of SEQ ID NO: 1902 | Amino Acid Sequence | 1min Deuteration | | | 20 min Deuteration | | |
|---|---|---|---|---|---|---|---|
| | | hMUC16.nub | hMUC16.nub + H4sH8767P | Δ | hMUC16.nub | hMUC16.nub + H4sH8767P | Δ |
| 428-434 | LYKGSQL | 809.97 ± 0.03 | 809.07 ± 0.06 | -0.26 | 811.05 ± 0.16 | 810.17 ± 0.01 | -0.88 |
| 429-434 | YKGSQL | 697.10 ± 0.00 | 696.74 ± 0.00 | -0.35 | 698.13 ± 0.02 | 697.60 ± 0.03 | -0.52 |
| 453-467 | VTVKALFSSNLDPSL | 1595.35 ± 0.08 | 1593.97 ± 0.2 | -1.38 | 1596.01 ± 0.08 | 1595.33 ± 0.03 | -0.68 |
| 459-467 | FFSNLDPSL | 983.19 ± 0.01 | 981.57 ± 0.08 | -1.62 | 983.51 ± 0.03 | 982.76 ± 0.07 | -0.75 |
| 460-467 | SSNLDPSL | 835.44 ± 0.01 | 834.01 ± 0.00 | -1.43 | 835.89 ± 0.01 | 835.12 ± 0.15 | -0.74 |
| 474-481 | DKTLNASF | 899.76 ± 0.00 | 899.25 ± 0.06 | -0.51 | 900.63 ± 0.00 | 900.10 ± 0.03 | -0.54 |

Using the online pepsin/protease XIII column coupled with MS$^E$ data acquisition, a total of 109 peptides from hMUC16.nub were identified in the absence or presence of the H1H8794P2, representing 64% sequence coverage. Three peptides had significantly reduced deuteration uptake (centroid delta values >0.5 daltons from at least one time point with p-values <0.05) when bound to H1H8794P2 and are illustrated in the Table 9B. The recorded peptide mass corresponds to the average value of the centroid MH$^+$ mass from three replicates. These peptides, corresponding to amino acids 126-131, 127-131, and 132-138 of hMuc16.nub, had slower deuteration rates when bound to H1H8794P2. These identified residues also correspond to residues 13935-13940, 13936-13940, and 13941-13947 of hMUC16 as defined by the Uniprot entry Q8WXI7 (MUC16_HUMAN), SEQ ID NO:1899.

TABLE 9B hMUC16.nub Peptides with Altered Deuteration Rates Upon Binding H1H8794P2

| Residues of SEQ ID NO: 1902 | Amino Acid Sequence | 1min Deuteration | | | 20 min Deuteration | | |
|---|---|---|---|---|---|---|---|
| | | hMUC16.nub | hMUC16.nub + H1H8794P2 | Δ | hMUC16.nub | hMUC16.nub + H1H8794P2 | Δ |
| 126-131 | LRYMAD | 771.41 ± 0.01 | 770.60 ± 0.04 | -0.81 | 771.91 ± 0.04 | 770.76 ± 0.02 | -1.15 |

TABLE 9B-continued hMUC16.nub Peptides with Altered Deuteration Rates Upon Binding H1H8794P2

| Residues of SEQ ID NO: 1902 | Amino Acid Sequence | 1min Deuteration | | | 20 min Deuteration | | |
|---|---|---|---|---|---|---|---|
| | | hMUC16.nub | hMUC16.nub + H1H8794P2 | Δ | hMUC16.nub | hMUC16.nub + H1H8794P2 | Δ |
| 127-131 | RYMAD | 658.03 ± 0.02 | 657.32 ± 0.01 | -0.71 | 657.89 ± 0.01 | 657.27 ± 0.01 | -0.6 |
| 132-138 | MGQPGSL | 692.55 ± 0.02 | 691.42 ± 0.15 | -1.13 | 692.61 ± 0.01 | 691.58 ± 0.02 | -1.03 |

Using the online pepsin/protease XIII column coupled with $MS^E$ data acquisition, a total of 109 peptides from hMUC16.nub were identified in the absence or presence of the H1H8799P2, representing 64% sequence coverage. Four peptides had significantly reduced deuteration uptake (centroid delta values >0.5 daltons from at least one time point with p-values <0.05) when bound to H1H8799P2 and are illustrated in the Table 9C. The recorded peptide mass corresponds to the average value of the centroid MH+ mass from three replicates. These peptides, corresponding to amino acids 357-369, 358-366, 358-369, and 361-369 of hMuc16.nub, had slower deuteration rates when bound to H1H8799P2. These identified residues also correspond to residues 14165-14178, 14166-14176, 14166-14178, and 14170-14178 of hMUC16 as defined by the Uniprot entry Q8WXI7 (MUC16_HUMAN), SEQ ID NO:1899.

Circulating antibody concentrations were determined by total human IgG antibody analysis using the GyroLab xPlore™ (Gyros, Uppsala, Sweden). Briefly, a biotinylated goat anti-human IgG polyclonal antibody (Jackson ImmunoResearch, West Grove, Pa.) was captured onto streptavidin coated beads on a Gyrolab Bioaffy 200 CD (Gyros) in order to capture the human IgG present in the sera. After affinity column capture, bound human IgG antibody in samples was detected with Alexa-647 labeled goat anti-human IgG (Jackson ImmunoResearch). Fluorescent signal on the column allowed for the detection of bound IgG and response units (RU) were read by the instrument. Sample concentrations were determined by interpolation from a standard curve that was fit using a 5-parameter logistic curve fit using the Gyrolab Evaluator Software. PK parameters were determined by non-compartmental analysis (NCA)

TABLE 9C hMUC16.nub Peptides with Altered Deuteration Rates Upon Binding H1H8799P2

| Residues of SEQ ID NO: 1902 | Amino Acid Sequence | 1min Deuteration | | | 20 min Deuteration | | |
|---|---|---|---|---|---|---|---|
| | | hMUC16.nub | hMUC16.nub + H1H8799P2 | Δ | hMUC16.nub | hMUC16.nub + H1H8799P2 | Δ |
| 357-369 | LSQLTHGVTQLGF | 1404.15 ± 0.03 | 1403.41 ± 0.09 | -0.74 | 1406.14 ± 0.15 | 1404.26 ± 0.02 | -2.11 |
| 358-366 | SQLTHGVTQL | 972.37 ± 0.10 | 972.04 ± 0.10 | -0.33 | 973.94 ± 0.03 | 972.56 ± 0.00 | -1.38 |
| 358-369 | SQLTHGVTQLGF | 1291.23 ± 0.02 | 1290.20 ± 0.00 | -1.03 | 1291.34 ± 0.02 | 1291.05 ± 0.06 | -2.27 |
| 361-369 | THGVTQLGF | 1404.15 ± 0.03 | 1403.42 ± 0.05 | -0.73 | 1406.10 ± 0.14 | 1404.03 ± 0.02 | -2.11 |

Example 7: Pharmacokinetic Assessment of Anti-MUC16×CD3 Bispecific Antibodies Assessment of the pharmacokinetics of anti-MUC16× CD3 bispecific antibodies BSMUC16/CD3-001 and BSMUC16/CD3-005 and an isotype control were conducted in humanized MUC16×CD3 mice (mice homozygous for human MUC16 and CD3 expression, MUC16$^{hu/hu}$× CD3$^{hu/hu}$), CD3 humanized mice (mice homozygous for human CD3 expression, CD3$^{hu/hu}$) and strain-matched (75% C57BL, 25%129Sv) wild-type (WT) mice. Cohorts contained 4-5 mice per tested antibody and per mouse strain. All mice received a single intra-peritoneal (i.p.) 0.4 mg/kg dose. Blood samples were collected at 3 and 6 hours, 1, 3, 7, 14 and 28 days post dosing. Blood was processed into serum and frozen at −80° C. until analyzed.

using Phoenix® WinNonlin® software Version 6.3 (Certara, L. P., Princeton, N.J.) and an extravascular dosing model. Using the respective mean concentration values for each antibody, all PK parameters including observed maximum concentration in serum ($C_{max}$), estimated half-life observed (t½), and area under the concentration curve versus time up to the last measureable concentration ($AUC_{last}$) were determined using a linear trapezoidal rule with linear interpolation and uniform weighting Following i.p. administration of antibodies in WT mice, the total IgG concentration-time profiles of BSMUC16/CD3-001, BSMUC16/CD3-005 and the isotype control were all similar, characterized first by a brief drug distribution followed by a single drug elimination phase throughout the remainder of the study. Maximum serum concentrations ($C_{max}$) and calculated drug exposure ($AUC_{last}$) of the three antibodies were comparable (within 1.3-fold of each other).

Following i.p. administration of antibodies in CD3$^{hu/hu}$ mice, BSMUC16/CD3-001, BSMUC16/CD3-005 and isotype control had comparable $C_{max}$ concentrations (4.6, 3.6 and 4.1 µg/mL, respectively). BSMUC16/CD3-005 and the isotype control exhibited similar drug elimination curves, while BSMUC16/CD3-001 exhibited steeper drug elimination than both, suggesting that human CD3 target binding drives clearance. Terminal antibody concentration for BSMUC16/CD3-001 was 0.03 µg/mL, which is about 28-fold less than terminal antibody concentrations determined for the isotype control (0.85 µg/mL) and 22-fold less than BSMUC16/CD3-005 (0.66 µg/mL) serum concentrations.

In MUC16$^{hu/hu}$×CD3$^{hu/hu}$ double-humanized mice, the Muc16×CD3 bispecific and isotype control antibodies had comparable $C_{max}$ concentrations ($C_{max}$ range: 4.5-6.9 µg/mL). Both bispecific antibodies exhibited steeper drug elimination than the isotype control suggesting a target-mediated effect. Terminal antibody concentrations for BSMUC16/CD3-001 and BSMUC16/CD3-005 were about 29-fold and 2.9-fold less, respectively, than terminal antibody concentrations determined for the isotype control (0.86 µg/mL).

A summary of the data for total anti-MUC16×CD3 bispecific antibodies and isotype control antibody concentrations are summarized in Table 10. Mean PK parameters are described in Tables 11A and 11B. Mean total antibody concentrations versus time are shown in FIGS. 1, 2, and 3.

In conclusion, MUC16×CD3 bispecific antibodies exhibited similar $C_{max}$ and drug elimination curves in WT mice, but BSMUC16/CD3-001 displayed steeper elimination rates than BSMUC16/CD3-005 and the isotype control in CD3 single-humanized mice and MUC16/CD3 double humanized mice. Since the bispecific antibodies administered in this PK study are comprised of the same anti-MUC16 binding arm, the results suggest that the strength of binding of the CD3 targeting arm may play a role in drug exposure levels (AUC$_{last}$) and drug elimination rates. Neither BSMUC16/CD3-001 or BSMUC16/CD3-005 bind mouse MUC16 or mouse CD3.

TABLE 10

Mean Concentrations of Total IgG in Serum Following a Single 0.4 mg/kg Intraperitoneal Injection of BSMUC16/CD3-001, BSMUC16/CD3-005 and Isotype Control Antibodies in WT Mice, Humanized CD3 Mice and Humanized MUC16 × CD3 mice

| | | Total mAb Concentration In Mouse Serum | | | | | |
|---|---|---|---|---|---|---|---|
| | | WT | | CD3$^{hu/hu}$ | | MUC16$^{hu/hu}$ × CD3$^{hu/hu}$ | |
| Antibody | Time (d) | Mean (µg/mL) | +/−SD | Mean (µg/mL) | +/−SD | Mean (µg/mL) | +/−SD |
| BSMUC16/ CD3-001 | 0.13 | 5.39 | 0.34 | 4.30 | 0.29 | 6.77 | 1.52 |
| | 0.25 | 5.80 | 0.36 | 4.26 | 1.07 | 6.63 | 1.06 |
| | 1.00 | 4.13 | 0.43 | 2.87 | 0.71 | 4.89 | 0.53 |
| | 3.00 | 3.19 | 0.53 | 1.44 | 0.27 | 2.50 | 0.22 |
| | 7.00 | 2.61 | 0.73 | 0.72 | 0.13 | 1.20 | 0.22 |
| | 14.00 | 1.44 | 0.69 | 0.18 | 0.05 | 0.28 | 0.08 |
| | 21.00 | 0.93 | ND | 0.07 | 0.02 | 0.06 | 0.05 |
| | 28.00 | 0.60 | ND | 0.04 | 0.01 | 0.03 | 0.02 |
| BSMUC16/ CD3-005 | 0.13 | 4.23 | 0.62 | 3.35 | 1.15 | 4.35 | 0.24 |
| | 0.25 | 4.53 | 0.55 | 3.40 | 0.96 | 4.45 | 0.49 |
| | 1.00 | 3.47 | 0.32 | 2.72 | 0.42 | 3.00 | 0.61 |
| | 3.00 | 2.51 | 0.13 | 1.95 | 0.37 | 1.98 | 0.41 |
| | 7.00 | 2.02 | 0.24 | 2.31 | 0.67 | 1.58 | 0.36 |
| | 14.00 | 1.19 | 0.17 | 1.01 | 0.23 | 0.78 | 0.26 |
| | 21.00 | 1.19 | 0.29 | 1.19 | 0.11 | 0.66 | 0.29 |
| | 28.00 | 0.71 | 0.20 | 0.66 | 0.28 | 0.30 | 0.22 |
| Isotype Control | 0.13 | 5.07 | 1.16 | 5.43 | 1.30 | 6.56 | 0.70 |
| | 0.25 | 5.91 | 1.10 | 5.67 | 1.91 | 6.48 | 0.90 |
| | 1.00 | 2.64 | 0.24 | 2.98 | 1.14 | 2.82 | 0.30 |
| | 3.00 | 2.05 | 0.06 | 2.29 | 0.83 | 1.57 | 0.37 |
| | 7.00 | 1.80 | 0.25 | 2.14 | 0.85 | 1.96 | 0.37 |
| | 14.00 | 1.22 | 0.28 | 1.48 | 0.66 | 1.34 | 0.37 |
| | 21.00 | 1.20 | 0.58 | 1.43 | 0.72 | 1.24 | 0.44 |
| | 28.00 | 0.73 | 0.24 | 0.85 | 0.29 | 0.86 | 0.41 |

Time: (h, when noted) = time in hours post single-dose injection; D = Day of study;
SD = Standard deviation;
ND = Not determined due to exclusion of mice with drug clearing anti-drug titers

TABLE 11A

Summary of Pharmacokinetic Parameters: $CD3^{hu/hu}$ humanized mice

| | | WT mice | | | $CD3^{hu/hu}$ mice | | |
|---|---|---|---|---|---|---|---|
| Parameter | Units | Isotype Control | BSMUC16/ CD3-001 | BSMUC16/ CD3-005 | Isotype Control | BSMUC16/ CD3-001 | BSMUC16/ CD3-005 |
| $C_{max}$ | µg/mL | 5 ± 3 | 6 ± 0.4 | 5 ± 0.5 | 4.1 ± 3 | 4.6 ± 0.8 | 3.5 ± 1 |
| $T_{1/2}$ | d | 11 ± 4 | 7 ± 3 | 12 ± 2 | 14 ± 0.5 | 3.9 ± 0.6 | 11 ± 5 |
| $AUC_{last}$ | d · µg/mL | 35 ± 18 | 40 ± 11 | 45 ± 5 | 49 ± 20 | 16 ± 3 | 36 ± 13 |

$C_{max}$ = Peak concentration;
AUC = Area under the concentration-time curve;
$AUC_{last}$ = AUC computed from time zero to the time of the last positive concentration;
$T_{1/2}$ = Estimated half-life observed

TABLE 11B

Summary of Pharmacokinetic Parameters: $MUC16^{hu/hu} \times CD3^{hu/hu}$ double-humanized mice

| | | WT mice | | | $MUC16^{hu/hu} \times CD3^{hu/hu}$ mice | | |
|---|---|---|---|---|---|---|---|
| Parameter | Units | Isotype Control | BSMUC16/ CD3-001 | BSMUC16/ CD3-005 | Isotype Control | BSMUC16/ CD3-001 | BSMUC16/ CD3-005 |
| $C_{max}$ | µg/mL | 5 ± 3 | 6 ± 0.4 | 5 ± 0.5 | 6.7 ± 0.7 | 6.9 ± 1 | 4.5 ± 4 |
| $T_{1/2}$ | d | 11 ± 4 | 7 ± 3 | 12 ± 2 | 12.9 ± 4 | 3.3 ± 0.8 | 8.2 ± 4 |
| $AUC_{last}$ | d · µg/mL | 35 ± 18 | 40 ± 11 | 45 ± 5 | 46 ± 10 | 27 ± 3 | 34 ± 11 |

$C_{max}$ = Peak concentration;
AUC = Area under the concentration-time curve;
$AUC_{last}$ = AUC computed from time zero to the time of the last positive concentration;
$T_{1/2}$ = Estimated half-life observed Example 8: Anti-MUC16/Anti-CD3 Bispecific Antibodies Display Potent Anti-Tumor Efficacy In Vivo To determine the in vivo efficacy of exemplary anti-MUC16/anti-CD3 bispecific antibodies identified as having weak or no detectable binding to human and cynomolgus CD3, studies were performed in immunocompromised mice bearing human prostate cancer xenografts. The efficacy of selected bispecific antibodies was tested in both immediate treatment and therapeutic treatment dosing models.

Efficacy of Anti-MUC16/Anti-CD3 Bispecific Antibodies in Human Tumor Xenograft Models To assess the in vivo efficacy of the anti-MUC16/anti-CD3 bispecifics in human tumor xenograft studies, NOD scid gamma (NSG) mice (Jackson Laboratories, Bar Harbor, Me.) were pre-implanted with human peripheral blood mononuclear cells (PBMCs; ReachBio LLC., Seattle, Wash.) and then given ascites cells from the human ovarian cancer cell line OVCAR-3 (American Type Tissue Culture, Manassas, Va.) transduced with luciferase (OVCAR-3/Luc). OVCAR-3 cells endogenously express MUC-16.

Briefly, NSG mice were injected intraperitoneally (i.p.) with $5.0 \times 10^6$ human PBMCs. 8d later, $1.5 \times 10^6$ ascites cells from the OVCAR-3/Luc cell line, previously passaged in vivo, were administered i.p. to the NSG mice engrafted with PBMCs. In the immediate treatment group, mice were treated i.p. on the day of OVCAR-3/Luc cell implantation with MUC16/CD3 Bispecific antibodies BSMUC16/CD3-001 or BSMUC16/CD3-005, or an isotype control, at a dose of 10 µg/mouse (N=5 mice/treatment group). In the therapeutic dose model, mice were treated i.p. 7d post tumor implantation with the MUC16/CD3 Bispecific or control antibodies described above, at a dose of 10 µg/mouse (N=5/treatment group).

In all studies, tumor growth was monitored via bioluminescent imaging (BLI). Mice were injected i.p. with the luciferase substrate D-luciferin suspended in PBS (150 mg/kg) and imaged under isoflurane anesthesia after 10 min. BLI was performed using the Xenogen IVIS system (Perkin Elmer, Hopkinton, Mass.) and BLI signals were extracted using Living Image software (Xenogen/Perkin Elmer). Regions of interest were drawn around each cell mass and photon intensities were recorded as photons(p)/sec(s)/cm$^2$/steradian(sr). For the immediate-treatment group, data is shown as BLI levels 26d post tumor implantation (Table 12A). For the therapeutic-treatment group, data is shown as fold-change in BLI between day 6 (1 d before treatment) and at study endpoint (26d post tumor implantation; Table 12B).

As the results show, both BSMUC16/CD3-001 and BSMUC16/CD3-005 showed similar efficacy in suppressing tumor growth compared to the isotype control when BLI was measured at Day 26 in the immediate dosing model. Both anti-MUC16/anti-CD3 bispecific antibodies also suppressed the growth of established tumors when administered 7d post tumor implantation, compared to the control. In summary, the bispecific anti-MUC16/anti-CD3 antibodies of this invention display potent anti-tumor efficacy in several models.

TABLE 12A

Efficacy of anti-MUC16/anti-CD3 Bispecific Antibodies in Immune-Compromised Xenograft Model: Immediate Dosing

| Tumor Model/ Mouse Strain/ Dose | Bispecific Antibody Identifier | N | Avg Bioluminescent Radiance (photons/sec/ cm$^2$/steradian) Day 26 (mean ± SD) |
|---|---|---|---|
| OVCAR-3/Luc/ NSG/ 10 µg/mouse | BSMUC16/CD3-001 | 5 | $1.4 \times 10^3 \pm 3.5 \times 10^2$ |
| | BSMUC16/CD3-005 | 5 | $1.5 \times 10^3 \pm 9.7 \times 10^2$ |
| | Isotype Control | 5 | $2.0 \times 10^7 \pm 1.0 \times 10^6$ |

TABLE 12B

Efficacy of anti-Muc16/anti-CD3 Bispecific Antibodies in
Immune-Compromised Xenograft Model: Therapeutic Treatment

| Tumor Model/<br>Mouse Strain/<br>Dose | Bispecific<br>Antibody<br>Identifier | N | Fold change in Avg<br>Bioluminescent Radiance<br>[p/s/cm$^2$/sr]<br>at Day 26 relative to<br>Day 6 (mean ± SD) |
|---|---|---|---|
| OVCAR-3/Luc/ | BSMUC16/CD3-001 | 5 | 2.0 ± 5.0 |
| NSG/ | BSMUC16/CD3-005 | 5 | 0.01 ± 0.02 |
| 10 µg/mouse | Isotype Control | 5 | 21.0 ± 8.0 |

Figure 4:
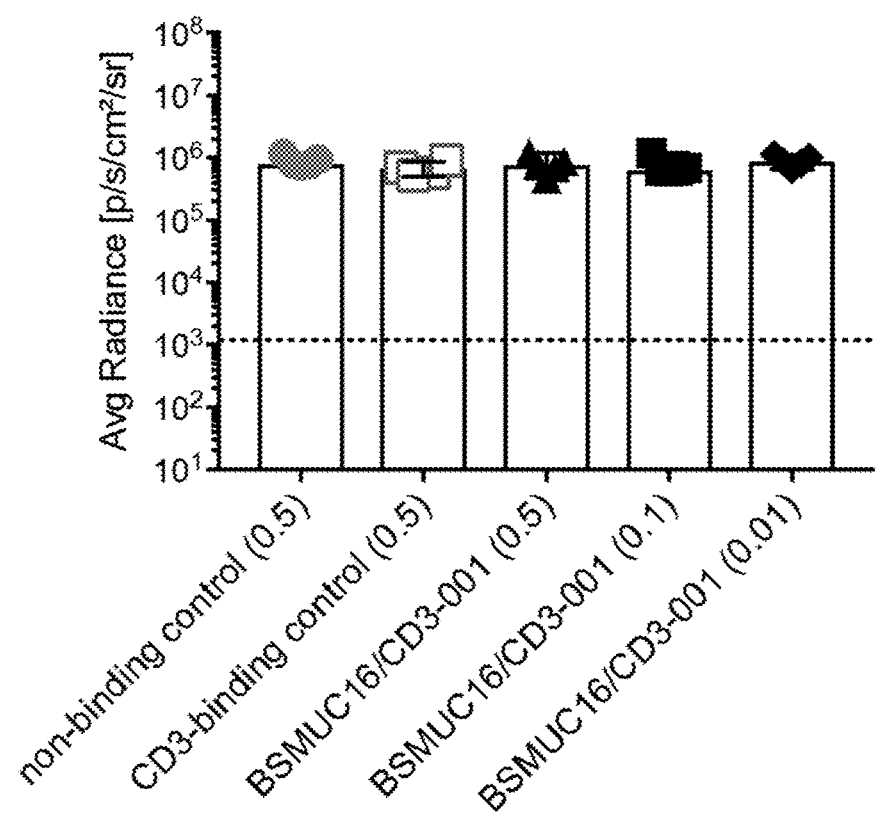
FIG. 4 shows the results of the OVCAR-3 model study 1 (Avg Radiance [p/s/cm$^2$/sr] at Day 6). All groups had similar tumor burden as assessed by BLI before dosing started. Data shown is tumor burden as assessed by BLI on Day 6 post tumor implantation. Statistical significance was determined using unpaired nonparametric Mann-Whitney t-tests. There was no significant difference in tumor burden between groups.
Figure 5:
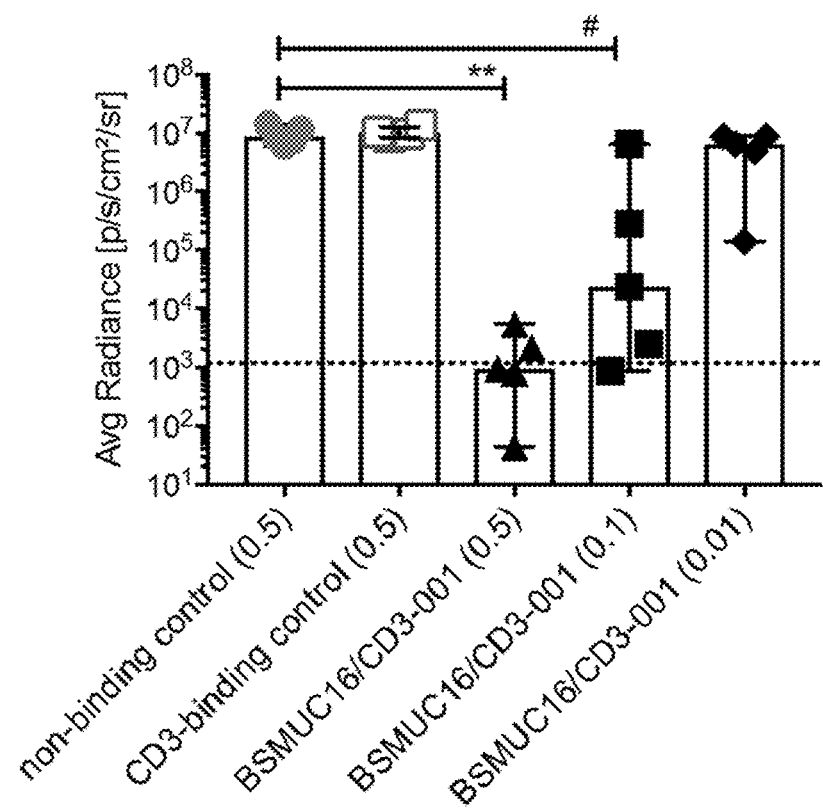
FIG. 5 shows the results of the OVCAR-3 model study 1 (Avg Radiance [p/s/cm2$^2$/sr] at Day 20). BSMUC16/CD3-001 significantly reduces tumor burden at 0.1 and 0.5 mg/kg. NSG mice engrafted with human T cells were implanted with human OVCAR-3/Luc cells. Treatment began 6 days post tumor implantation. Mice were treated on Days 6, 10, 13, 16 and 21 with 0.01, 0.1, or 0.5 mg/kg BSMUC16/CD3-001 administered IP or treated with a CD3-binding control or non-binding control (0.5 mg/kg IP). Data shown is tumor burden as assessed by BLI on Day 20 post tumor implantation. Statistical significance was determined using unpaired nonparametric Mann-Whitney t-tests. Treatment with BSMUC16/CD3-001 was compared to the non-binding control (** $p<0.01$ for 0.5 mg/kg, # $p<0.05$ for 0.1 mg/kg BSMUC16/CD3-001).
Figure 6:
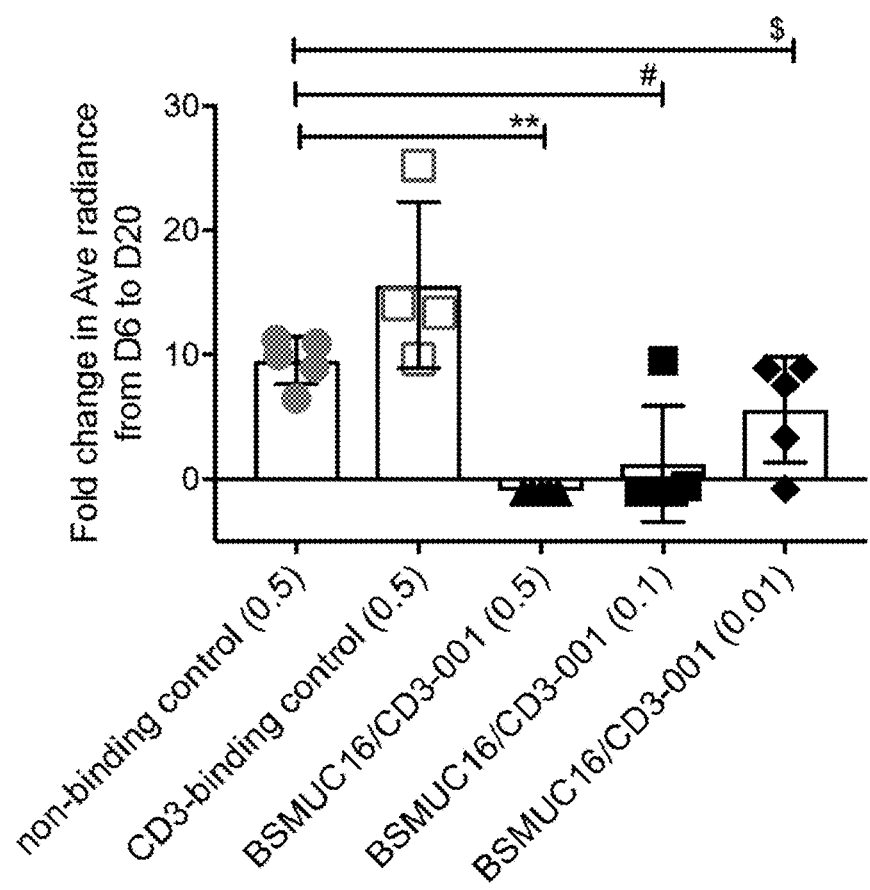
FIG. 6 shows the results of the OVCAR-3 model study 1 (Fold change in BLI-evident tumors between D6 and D20). BSMUC16/CD3-001 significantly reduces fold change in tumor burden at 0.01, 0.1, and 0.5 mg/kg. NSG mice engrafted with human T cells were implanted with human OVCAR-3/Luc cells. Mice were treated on Days 6, 10, 13, 16 and 21 with 0.01, 0.1 or 0.5 mg/kg BSMUC16/CD3-001 administered IP or treated with a CD3-binding control or non-binding control (0.5 mg/kg IP). Data shown is fold change in tumor burden from first measurement (taken before treatment began) and on Day 20 at end of study. Statistical significance was determined using unpaired nonparametric Mann-Whitney t-tests. Treatment with BSMUC16/CD3-001 was compared to the non-binding control (** $p<0.01$ for 0.5 mg/kg, # $p<0.05$ for 0.1 mg/kg, \$ $p<0.05$ for 0.01 mg/kg BSMUC16/CD3-001).
Figure 7:
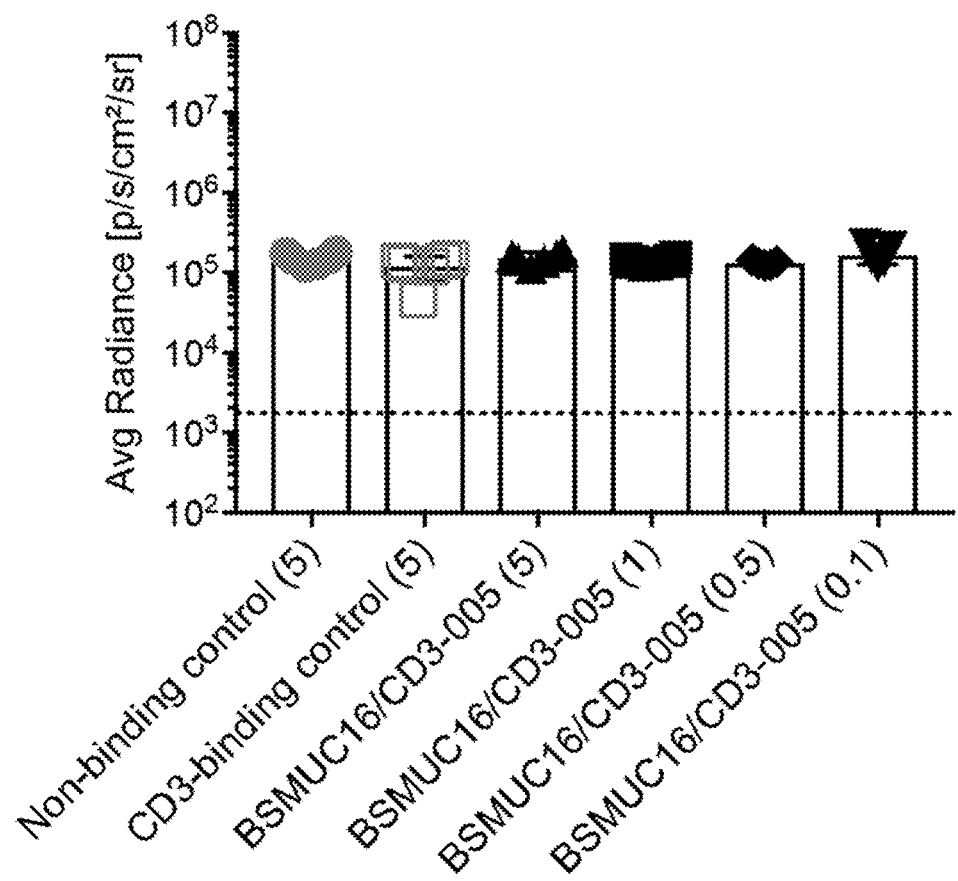
FIG. 7 shows the results of the OVCAR-3 model study 2 (Avg Radiance [p/s/cm$^2$/sr] at Day 4). All groups had similar tumor burden as assessed by BLI before dosing started. Data shown is tumor burden as assessed by BLI on Day 4 post tumor implantation. Statistical significance was determined using unpaired nonparametric Mann-Whitney t-tests. There was no significant difference in tumor burden at Day 4 between groups.
Figure 8:
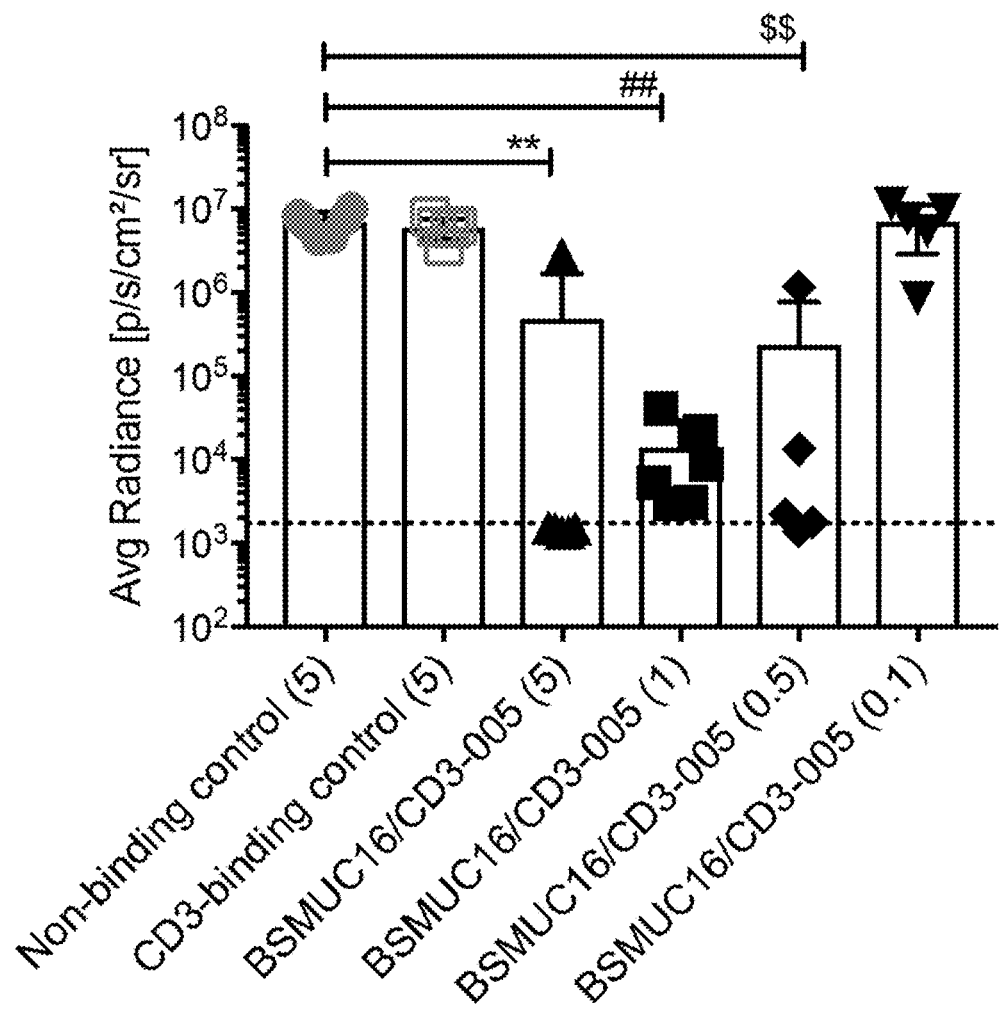
FIG. 8 shows the results of the OVCAR-3 model study 2 (Avg Radiance [p/s/cm2$^2$/sr] at Day 25). BSMUC16/CD3-005 significantly reduces tumor burden at 0.5, 1 and 5 mg/kg. NSG mice engrafted with human T cells were implanted with human OVCAR-3/Luc cells. Treatment began 5 days post tumor implantation. Mice were treated on Days 5, 8, 12, 15, 19, and 22 with 0.1, 0.5, 1, or 5 mg/kg REGN4019 administered IV or administered a CD3-binding control or non-binding control (5 mg/kg IV). Data shown is tumor burden as assessed by BLI on Day 25 post tumor implantation. Statistical significance was determined using unpaired nonparametric Mann-Whitney t-tests. Treatment with BSMUC16/CD3-005 was compared to the non-binding control (** $p<0.01$ for 5 mg/kg, ## $p<0.01$ for 1 mg/kg, \$\$ $p<0.01$ for 0.5 mg/kg BSMUC16/CD3-005).
Figure 9:
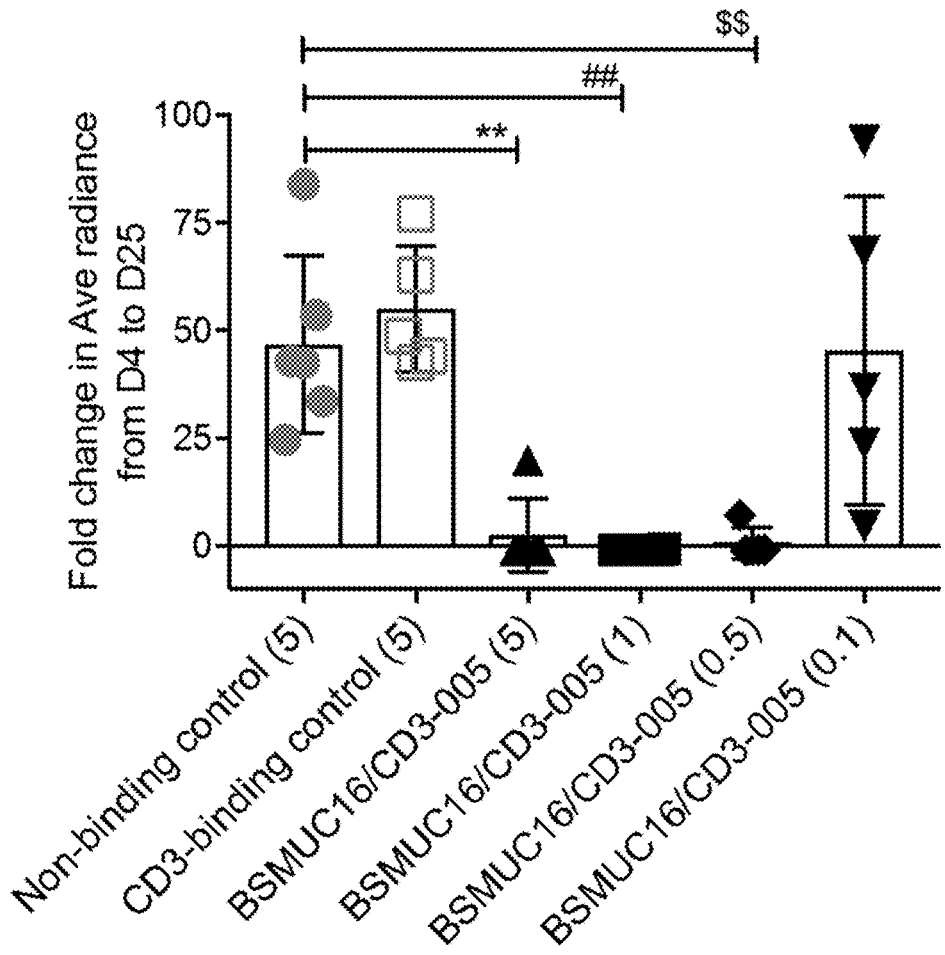
FIG. 9 shows the results of the OVCAR-3 model study 2 (Fold change in BLI-evident tumors between D4 and D25). BSMUC16/CD3-005 significantly reduces tumor growth at 0.5, 1 and 5 mg/kg. NSG mice engrafted with human T cells were implanted with human OVCAR-3/Luc cells. Mice were treated on Days 5, 8, 12, 15, 19, and 22 with 0.1, 0.5, 1, or 5 mg/kg REGN4019 administered IV or treated with a CD3-binding control or non-binding control (5 mg/kg IV). Data shown is fold change in tumor burden from first measurement (taken the day before treatment began) and on Day 25, at end of study. Statistical significance was determined using unpaired nonparametric Mann-Whitney t-tests. Treatment with BSMUC16/CD3-005 was compared to the non-binding control (** $p<0.01$ for 5 mg/kg, ## $p<0.01$ for 1 mg/kg, \$\$ $p<0.01$ for 0.5 mg/kg REGN4019).
Figure 10:
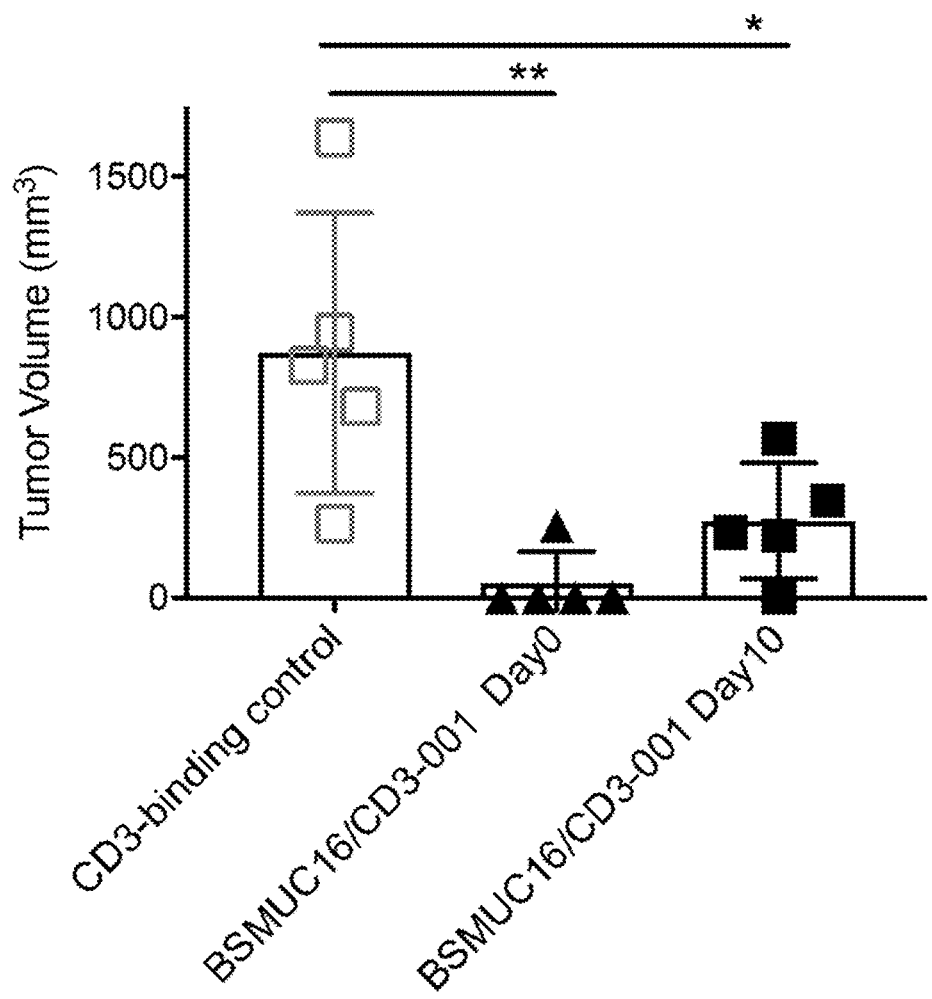
FIG. 10 shows the results of the ID8-VEGF/huMUC16 model. Tumor size at Day 47 post implantation BSMUC16/CD3-001 significantly reduces tumor growth in a syngeneic model when treatment begins either on day of implantation or 10 days post tumor implantation. Mice expressing human CD3 in place of mouse CD3 and a chimeric MUC16 molecule were implanted with the murine ovarian tumor line expressing a portion of human MUC16. Mice were administered BSMUC16/CD3-001 (100 ug IP) on day of implantation or 10 days post implantation or administered CD3-binding control (100 ug IP) on day of implantation. Mice were treated on Days 0, 4, 7, 10, 13, 17, 20 or 24 for immediate-treatment groups and on days 10, 13, 17, 20 and 24 for the group where dosing started on D10. Data shown is tumor volume on Day 47 post implantation. Statistical significance was determined using unpaired nonparametric Mann-Whitney t-tests. Treatment with BSMUC16/CD3-001 was compared to the CD3-binding control (** $p<0.01$ starting at D0, * $p<0.05$ starting at D10).

In further experiments, the in vivo efficacy of an anti-MUC16/anti-CD3 bispecific antibody was evaluated in xenogenic and syngeneic tumor models. For the first xenogenic model, NSG mice were injected intraperitoneally (IP) with OVCAR-3/Luc cells previously passaged in vivo (Day 0) eleven days after engraftment with human PBMCs. Mice were treated IP with 0.01, 0.1, or 0.5 mg/kg BSMUC16/CD3-001, or administered 0.5 mg/kg non-binding control or CD3-binding control on Days 6, 10, 13, 16, and 21. Tumor burden was assessed by BLI on Days 6, 14, and 20 post tumor implantation. Treatment with 0.1 or 0.5 mg/kg of BSMUC16/CD3-001 resulted in significant anti-tumor efficacy as determined by BLI measurements on Day 20, as shown in Tables 13A-C and in FIGS. 4-6. For the second xenogenic model, NSG mice were injected with OVCAR-3/Luc cells previously passaged in vivo (Day 0) thirteen days after engraftment with human PBMCs and a second batch of PBMCs were transferred on Day 4. Mice were treated intravenously (IV) with 0.1, 0.5, 1, or 5 mg/kg BSMUC16/CD3-005 or administered 5 mg/kg non-binding control or CD3-binding control on Days 5, 8, 12, 15, 19 and 22. Tumor burden was assessed by BLI on Days 4, 11, 18 and 25. Treatment with 0.5, 1, or 5 mg/kg BSMUC16/CD3-005 resulted in significant anti-tumor efficacy as shown by BLI measurements and fold changes (Tables 13D-F and FIGS. 7-9). To examine efficacy in an immune-competent model, the murine CD3 gene was replaced with human CD3 and a portion of the mouse MUC16 gene was replaced with the human sequence. The replacements resulted in a mouse whose T cells express human CD3 and that expresses a chimeric MUC16 molecule containing a portion of human MUC16 where the BSMUC16/CD3-001 bispecific antibody binds. For the syngeneic tumor model, ID8-VEGF cell lines engineered to express the portion of human MUC16 were used. Mice were implanted with the ID8-VEGF/huMUC16 cells subcutaneously and treated with 100 µg of BSMUC16/CD3-001 either on day of implantation or ten days after implantation when tumors were established. Treatment with 100 µg BSMUC16/CD3-001 resulted in significant anti-tumor efficacy, as shown in Table 13G and FIG. 10.

Implantation and Measurement of Xenograft Tumors:

Ascites cells from the OVCAR-3/Luc cell line, previously passaged in vivo, were administered IP into the NSG mice previously engrafted with human PBMCs. BLI was measured as a read-out for tumor growth several days after OVCAR-3/Luc implantation and at multiple times during study. After initial BLI measurement for cohorting, mice were divided into groups of 4-6 animals each and administered MUC16×CD3 bispecific or control antibodies twice per week throughout the study.

Calculation of Xenograft Tumor Growth and Inhibition:

Bioluminescence imaging was used to measure tumor burden. Mice were injected IP with 150 mg/kg (as determined by body weights at the start of the experiment) of the luciferase substrate D-luciferin suspended in PBS. Ten minutes after dosing, BLI imaging of the mice was performed under isoflurane anesthesia using the Xenogen IVIS system. Image acquisition was carried out with the field of view at D, subject height of 1.5 cm, and medium binning level for 0.5-min exposure time. BLI signals were extracted using Living Image software. Regions of interest were drawn around each tumor mass and photon intensities were recorded as p/s/cm$^2$/sr. Statistical analysis was performed using GraphPad Prism software (Version 6). Statistical significance for the BLI results was determined using an unpaired nonparametric Mann-Whitney t-test. Fold changes were calculated by the formula: (Day20-Day6)/Day6 for study 1 and (Day25-Day4)/Day4 for study 2.

Implantation and Measurement of Syngeneic Tumors:

Mice expressing human CD3 and a human-murine chimera of MUC16 in the corresponding mouse loci were implanted with 10e6 ID8-VEGF/huMUC16 cells subcutaneously (SC). Mice were administered BSMUC16/CD3-001 or a CD3-binding control IP, twice per week throughout study. Treatment began on Day 0 or Day 10 post implantation. Tumor growth was measured with calipers twice per week. Mice were sacrificed 47 days after tumor implantation.

Calculation of Syngeneic Tumor Growth and Inhibition:

In order to determine tumor volume by external caliper, the greatest longitudinal diameter (length) and the greatest transverse diameter (width) were determined. Tumor volume based on caliper measurements were calculated by the formula: Volume=(length×width$^2$)/2. Statistical significance was determined using an unpaired nonparametric Mann-Whitney t-test.

The anti-tumor efficacy of the BSMUC16/CD3-001 bispecific antibody in the xenogenic and syngeneic in vivo tumor models is shown in Tables 13A-D, below.

TABLE 13A

OVCAR-3 model study 1. Level of Bioluminescence
on Day 6 post tumor implantation

| Antibody (mg/kg) | Avg Radiance [p/s/cm2$^2$/sr]<br>6 days post-implantation<br>(median ± SEM) |
|---|---|
| non-binding control (0.5) | 8.15e+05 ± 7.88e+04 |
| CD3-binding control (0.5) | 6.39e+05 ± 8.67e+04 |
| BSMUC16/CD3-001 (0.5) | 7.64e+05 ± 1.19e+05 |
| BSMUC16/CD3-001 (0.1) | 6.31e+05 ± 1.10e+05 |
| BSMUC16/CD3-001 (0.01) | 8.77e+05 ± 7.91e+04 |

TABLE 13B

OVCAR-3 model study 1. Level of Bioluminescence
on Day 20 post tumor implantation

| Antibody (mg/kg) | Avg Radiance [p/s/cm2$^2$/sr]<br>20 days post-implantation<br>(median ± SEM) |
|---|---|
| non-binding control (0.5) | 8.63e+06 ± 1.45e+06 |
| CD3-binding control (0.5) | 9.94e+06 ± 1.08e+06 |
| BSMUC16/CD3-001 (0.5) | 9.37e+02 ± 9.62e+02 |
| BSMUC16/CD3-001 (0.1) | 2.36e+04 ± 1.28e+06 |
| BSMUC16/CD3-001 (0.01) | 6.51e+06 ± 1.60e+06 |

TABLE 13C

OVCAR-3 model study 1. Fold Change in BLI between Day 6 and Day 20 post tumor implantation

| Antibody (mg/kg) | Fold change in Avg Radiance [p/s/cm2²/sr] from Day 6 to D 20 post-implantation (mean ± SD) |
|---|---|
| non-binding control (0.5) | 9.5 ± 1.9 |
| CD3-binding control (0.5) | 15.6 ± 6.7 |
| BSMUC16/CD3-001 (0.5) | −1.00 ± 0.00 |
| BSMUC16/CD3-001 (0.1) | 1.2 ± 4.7 |
| BSMUC16/CD3-001 (0.01) | 5.6 ± 4.2 |

TABLE 13D

OVCAR-3 model study 2. Level of Bioluminescence on Day 4 post tumor implantation

| Antibody (mg/kg) | Avg Radiance [p/s/cm2²/sr] 4 days post-implantation (median ± SEM) |
|---|---|
| non-binding control (5) | 1.54e+05 ± 9.93e+03 |
| CD3-binding control (5) | 1.34e+05 ± 1.55e+04 |
| BSMUC16/CD3-005 (5) | 1.54e+05 ± 1.03e+04 |
| BSMUC16/CD3-005 (1) | 1.38e+05 ± 4.65e+03 |
| BSMUC16/CD3-005 (0.5) | 1.31e+05 ± 4.03e+03 |
| BSMUC16/CD3-005 (0.1) | 1.53e+05 ± 1.93e+04 |

TABLE 13E

OVCAR-3 model study 2. Level of Bioluminescence on Day 25 post tumor implantation

| Antibody (mg/kg) | Avg Radiance [p/s/cm2²/sr] 25 days post-implantation (median ± SEM) |
|---|---|
| non-binding control (5) | 7.20e+06 ± 8.91e+05 |
| CD3-binding control (5) | 6.15e+06 ± 7.26e+05 |
| BSMUC16/CD3-005 (5) | 1.52e+03 ± 4.86e+05 |
| BSMUC16/CD3-005 (1) | 6.99e+03 ± 6.23e+03 |
| BSMUC16/CD3-005 (0.5) | 2.23e+03 ± 2.35e+05 |
| BSMUC16/CD3-005 (0.1) | 7.63e+06 ± 1.83e+06 |

TABLE 13F

OVCAR-3 model study 2. Fold Change in BLI between Day 4 and Day 25 post tumor implantation

| Antibody (mg/kg) | Fold change in Avg Radiance [p/s/cm2²/sr] from Day 4 to D 25 post-implantation (mean ± SD) |
|---|---|
| non-binding control (5) | 46.8 ± 20.6 |
| CD3-binding control (5) | 55.0 ± 14.7 |
| BSMUC16/CD3-005 (5) | 2.5 ± 8.5 |
| BSMUC16/CD3-005 (1) | −0.9 ± 0.1 |
| BSMUC16/CD3-005 (0.5) | 0.7 ± 3.6 |
| BSMUC16/CD3-005 (0.1) | 45.4 ± 35.7 |

TABLE 13G

ID8-VEGF/huMUC16 model. Tumor size (mm3) at Day 47

| Treatment start | Antibody (μg) | Tumor size (mm3) at Day 47 (mean ± SEM) |
|---|---|---|
| Day 0 | CD3-binding control (100) | 827.5 ± 223.5 |
| Day 0 | BSMUC16/CD3-001 (100) | 51.2 ± 51.2 |
| Day 10 | BSMUC16/CD3-001 (100) | 273.8 ± 92.36 |

Example 9: Conjugate Preparation and Characterization

All the monoclonal antibodies were expressed in CHO cells and purified by Protein A. An isotype control was also prepared in a similar fashion. The non-binding isotype control antibody was derived from an immunological antigen having no relation to oncology.

The antibody (10 mg/ml) in 50 mM HEPES, 150 mM NaCl, pH 7.5, was treated with 1 mM dithiothreitol at 37° C. for 30 min. After gel filtration (G-25, pH 4.5 sodium acetate), one of the maleimido linker payload derivatives Compound 7 or Compound 10 (see Table 14) (1.2 equivalents/SH group) in DMSO (10 mg/ml) was added to the reduced antibody and the mixture adjusted to pH 7.0 with 1 M HEPES (pH 7.4). Compound 7 and Compound 10, and methods of making the compounds, are described in PCT Publication No. WO2014/145090, published on Sep. 18, 2014 and PCT Publication No. WO2016/160615, published on Oct. 6, 2016, respectively, each of which is entirely incorporated herein by reference. After 1 h the reaction was quenched with excess N-ethyl maleimide. The conjugates were purified by size exclusion chromatography and sterile filtered. Protein and linker payload concentrations were determined by UV spectral analysis. Size-exclusion HPLC established that all conjugates used were >95% monomeric. Yields are reported in Table 14 based on protein determinations. All conjugated antibodies were analyzed by UV for linker payload loading values according to Hamblett et al, Cancer Res 2004 10 7063. The results are summarized in Table 14.

A conjugate comprising Compound 60 can be prepared using a similar method. Compound 60, and methods of making the compound, is described in PCT Publication No. WO2016/160615 (Example 20), published on Oct. 6, 2016, which is entirely incorporated herein by reference. Compound 60 is Maytansin-N-methyl-L-alanine-(3-methoxy-4-amino)benzamido-Cit-Val-Cap-Mal.

TABLE 14

Summary of Payload (Chemotoxic Drug) and Antibody-Drug-Conjugate Parameters

| Compound | ε252 nm (cm⁻¹ M⁻¹) | ε280 nm (cm⁻¹ M⁻¹) |
|---|---|---|
| 7 [Maytansin-3-N-methyl-L-(S)-alanine-propanamidyl-3-N-methyl-N-[4-(amino-citrulline-valine-hexanamide-6-maleimidy/)benzyl]carbamate] | 50600 | 8100 |
| 10 [Maytansin-N-methyl-L-alanine-4-aminobenzamide-citrulline-valine-caprolyl-6-maleimidyl] | 45990 | 20600 |

| Antibody | ε252 nm (cm⁻¹ M⁻¹) | ε280 nm (cm⁻¹ M⁻¹) |
|---|---|---|
| H1H9519N | 83995 | 235280 |
| H1H9521N | 85564 | 232050 |
| Isotype Control | 75113 | 218360 |

| Antibody Conjugate | Payload:Antibody (UV) | Yield % |
|---|---|---|
| H1H9519N-7 | 3.5 | 40 |
| H1H9521N-7 | 3.6 | 40 |
| H1H9521N-10 | 3.0 | 40 |
| Isotype Control-7 | 3.0 | 60 |
| Isotype Control-10 | 3.4 | 60 |

Example 10: Anti-MUC16 Antibody Drug Conjugates are Potent Inhibitors of Tumor Growth in In Vivo MUC16-Positive Prostate Cancer Xenograft Models To determine the in vivo efficacy of the anti-MUC16 antibodies conjugated to Compound 7 and Compound 10, studies were performed in immunocompromised mice bearing MUC16 positive ovarian cancer xenografts.

For these studies, female SCID mice (Taconic, Hudson N.Y.) were implanted with OVCAR3 [NIH:OVCAR-3 (OVCAR3, ATCC HTB-161)] cells transfected with luciferase (OVCAR3/luc) that endogenously express MUC16. For intraperitoneal (IP) tumors, mice were randomized into treatment groups, and dosed with either anti-MUC16 drug conjugated antibodies (see Example 9), a non-binding conjugated antibody, or vehicle following detection of tumor luminescent signal. For subcutaneous (SC) xenografts, once tumors had reached an average volume of 200 mm$^3$ (~Day 16), mice were randomized into treatment groups, and dosed with either anti-MUC16 drug conjugated antibodies, a non-binding conjugated antibody, or vehicle. In these in vivo studies, antibodies were dosed and tumors were then monitored until ascites developed or an average tumor size of approximately 1200 mm$^3$ was attained in the cohort dosed with vehicle alone. At this point the Tumor Growth Inhibition was calculated.

In an initial intraperitoneal (IP) study, exemplary anti-MUC16 antibodies conjugated to Compound 7 were examined for efficacy in reducing OVCAR3/luc luminescent signal. Mice received four once weekly doses of anti-MUC16 and control ADCs at 85 µg/kg of drug equivalent based on ADC drug:antibody ratios. As summarized in Table 15A, H1H9519N-Compound 7 and H1H9521N-Compound 7 potently inhibited ascites tumor growth. These anti-MUC16 ADCs efficiently reduced tumor size, with a 100 percent reduction in tumor luminescence relative to vehicle control. The Control ADC did not mediate any inhibition of OVCAR/luc ascites tumor cell growth.

A further study assessing the efficacy of anti-MUC16 ADCs against subcutaneous (SC) OVCAR3/luc tumor is summarized in Table 15B. Mice received four once weekly doses of anti-MUC16 and control ADCs at 85 µg/kg of drug equivalent based on ADC drug:antibody ratios. When conjugated to Compound 7, MUC16 ADCs H1H9519N-Compound 7 and H1H9521N-Compound 7 again produced significant anti-tumor effect; this time against the subcutaneous OVCAR3/luc tumors. Accordingly, these ADCs mediated a 100% and 109% inhibition of tumor growth respectively. Control ADC did not mediate any inhibition of OVCAR/luc subcutaneous tumor growth.

In a third study, the efficacy of the anti-MUC16 antibody H1H9521N conjugated to the linker drug Compound 10 was assessed in the IP OVCAR3/luc tumor model. Mice received single doses of anti-MUC16 and control ADCs at 85 µg/kg, 170 µg/kg and 340 µg/kg of drug equivalent based on ADC drug:antibody ratios. As summarized in Table 15C, H1H9519N-10 potently inhibited ascites tumor growth. The doses of H1H9519N-Compound 10 resulted in a 99-100% inhibition of tumor luminescence relative to vehicle control. Some inhibition was observed with Control ADC using Compound 10 although this was more moderate than that observed following anti-MUC16 H1H9519N-Compound 10.

TABLE 15A

Inhibition of OVCAR3/luc IP Tumor Growth at Day 49 in SCID mice treated with anti-MUC16 antibodies conjugated to Compound 7

| Treatment Group | Final Tumor Average Radiance (mean ± SEM) | Average Tumor Growth Inhibition (%) |
| --- | --- | --- |
| Vehicle | 16469750 ± 10679335 | 0 |
| Control- Compound 7 85 µg/kg | 16813750 ± 4026065 | −2 |
| H1H9519N- Compound 7 85 µg/kg | 111254 ± 187288 | 100 |
| H1H9521N- Compound 7 85 µg/kg | 110413 ± 161353 | 100 |

TABLE 15B

Inhibition of OVCAR3/luc SC Tumor Growth at Day 37 in SCID mice treated with anti-MUC16 antibodies conjugated to Compound 7

| Treatment Group | Final Tumor Volume (mean ± SEM) | Average Tumor Growth Inhibition (%) |
| --- | --- | --- |
| Vehicle | 1210 ± 426 | 0 |
| Control- Compound 7 85 µg/kg | 1737 ± 391 | −51 |
| H1H9519N- Compound 7 85 µg/kg | 187 ± 269 | 100 |
| H1H9521N- Compound 7 85 µg/kg | 89 ± 97 | 109 |

TABLE 15C

Inhibition of OVCAR3/luc IP Tumor Growth at Day 49 in SCID mice treated with anti-MUC16 antibodies conjugated to Compound 10

| Treatment Group | Final Tumor Radiance (mean ± SEM) | Average Tumor Growth Inhibition (%) |
| --- | --- | --- |
| Vehicle | 29211000 ± 23504780 | 0 |
| Control- Compound 10 85 µg/kg | 17332625 ± 14346694 | 41 |
| Control- Compound 10 170 µg/kg | 32075000 ± 15623403 | −10 |
| Control- Compound 10 340 µg/kg | 22882350 ± 18771913 | 22 |
| H1H9521N- Compound 10 85 µg/kg | 574285 ± 306844 | 99 |
| H1H9521N- Compound 10 170 µg/kg | 236037 ± 226948 | 100 |
| H1H9521N- Compound 10 340 µg/kg | 26472 ± 25079 | 101 |

Example 11: Generation of Anti-CD3 Antibodies

Anti-CD3 antibodies were obtained by immunizing an engineered mouse comprising DNA encoding human Immunoglobulin heavy and kappa light chain variable regions with cells expressing CD3 or with DNA encoding CD3. The antibody immune response was monitored by a CD3-specific immunoassay. When a desired immune response was achieved, splenocytes were harvested and fused with mouse myeloma cells to preserve their viability and form hybridoma cell lines. The hybridoma cell lines were screened and selected to identify cell lines that produce CD3-specific antibodies. Using this technique several anti-CD3 chimeric antibodies (i.e., antibodies possessing human variable domains and mouse constant domains) were obtained. In addition, several fully human anti-CD3 antibodies were isolated directly from antigen-positive B cells without fusion to myeloma cells, as described in US 2007/0280945A1.

Certain biological properties of the exemplary anti-CD3 antibodies generated in accordance with the methods of this Example are described in detail in the Examples herein.

Example 12: Heavy and Light Chain Variable Region Amino Acid and Nucleic Acid Sequences Table 16 sets forth the amino acid sequence identifiers of the heavy and light chain variable regions and CDRs of selected anti-CD3 antibodies of the invention. The corresponding nucleic acid sequence identifiers are set forth in Table 17. Methods of making the anti-CD3 antibodies disclosed herein can also be found in US publication 2014/0088295.

TABLE 16

Amino Acid Sequence Identifiers

| Antibody Designation | SEQ ID NOs: | | | | | | |
|---|---|---|---|---|---|---|---|
| | HCVR | HCDR1 | HCDR3 | LCVR | LCDR11 | LCDR2 | LCDR3 |
| H1H2712N | 402 | 404 | 406 | 408 | 410 | 412 | 414 | 416 |
| H1M2692N | 418 | 420 | 422 | 424 | 426 | 428 | 430 | 432 |
| H1M3542N | 434 | 436 | 438 | 440 | 442 | 444 | 446 | 448 |
| H1M3544N | 450 | 452 | 454 | 456 | 458 | 460 | 462 | 464 |
| H1M3549N | 466 | 468 | 470 | 472 | 474 | 476 | 478 | 480 |
| H1M3613N | 482 | 484 | 486 | 488 | 490 | 492 | 494 | 496 |
| H2M2689N | 498 | 500 | 502 | 504 | 506 | 508 | 510 | 512 |
| H2M2690N | 514 | 516 | 518 | 520 | 522 | 524 | 526 | 528 |
| H2M2691N | 530 | 532 | 534 | 536 | 538 | 540 | 542 | 544 |
| H2M2704N | 546 | 548 | 550 | 552 | 554 | 556 | 558 | 560 |
| H2M2705N | 562 | 564 | 566 | 568 | 570 | 572 | 574 | 576 |
| H2M2706N | 578 | 580 | 582 | 584 | 586 | 588 | 590 | 592 |
| H2M2707N | 594 | 596 | 598 | 600 | 602 | 604 | 606 | 608 |
| H2M2708N | 610 | 612 | 614 | 616 | 618 | 620 | 622 | 624 |
| H2M2709N | 626 | 628 | 630 | 632 | 634 | 636 | 638 | 640 |
| H2M2710N | 642 | 644 | 646 | 648 | 650 | 652 | 654 | 656 |
| H2M2711N | 658 | 660 | 662 | 664 | 666 | 668 | 670 | 672 |
| H2M2774N | 674 | 676 | 678 | 680 | 682 | 684 | 686 | 688 |
| H2M2775N | 690 | 692 | 694 | 696 | 698 | 700 | 702 | 704 |
| H2M2776N | 706 | 708 | 710 | 712 | 714 | 716 | 718 | 720 |
| H2M2777N | 722 | 724 | 726 | 728 | 730 | 732 | 734 | 736 |
| H2M2778N | 738 | 740 | 742 | 744 | 746 | 748 | 750 | 752 |
| H2M2779N | 754 | 756 | 758 | 760 | 762 | 764 | 766 | 768 |
| H2M2789N | 770 | 772 | 774 | 776 | 778 | 780 | 782 | 784 |
| H2M2862N | 786 | 788 | 790 | 792 | 794 | 796 | 798 | 800 |
| H2M2885N | 802 | 804 | 806 | 808 | 810 | 812 | 814 | 816 |
| H2M2886N | 818 | 820 | 822 | 824 | 826 | 828 | 830 | 832 |
| H2M3540N | 834 | 836 | 838 | 840 | 842 | 844 | 846 | 848 |
| H2M3541N | 850 | 852 | 854 | 856 | 858 | 860 | 862 | 864 |
| H2M3543N | 866 | 868 | 870 | 872 | 874 | 876 | 878 | 880 |
| H2M3547N | 882 | 884 | 886 | 888 | 890 | 892 | 894 | 896 |
| H2M3548N | 898 | 900 | 902 | 904 | 906 | 908 | 910 | 912 |
| H2M3563N | 914 | 916 | 918 | 920 | 922 | 924 | 926 | 928 |
| H1H5751P | 930 | 932 | 934 | 936 | 938 | 940 | 942 | 944 |
| H1H5752P | 946 | 948 | 950 | 952 | 954 | 956 | 958 | 960 |
| H1H5753B | 962 | 964 | 966 | 968 | 970 | 972 | 974 | 976 |
| H1H5754B | 978 | 980 | 982 | 984 | 986 | 988 | 990 | 992 |
| H1H5755B | 994 | 996 | 998 | 1000 | 1002 | 1004 | 1006 | 1008 |
| H1H5756B | 1010 | 1012 | 1014 | 1016 | 1018 | 1020 | 1022 | 1024 |
| H1H5757B | 1026 | 1028 | 1030 | 1032 | 1034 | 1036 | 1038 | 1040 |
| H1H5758B | 1042 | 1044 | 1046 | 1048 | 1050 | 1052 | 1054 | 1056 |
| H1H5761P | 1058 | 1060 | 1062 | 1064 | 1066 | 1068 | 1070 | 1072 |
| H1H5763P | 1074 | 1076 | 1078 | 1080 | 1082 | 1084 | 1086 | 1088 |
| H1H5764P | 1090 | 1092 | 1094 | 1096 | 1098 | 1100 | 1102 | 1104 |
| H1H5769P | 1106 | 1108 | 1110 | 1112 | 1114 | 1116 | 1118 | 1120 |
| H1H5771P | 1122 | 1124 | 1126 | 1128 | 1130 | 1132 | 1134 | 1136 |
| H1H5772P | 1138 | 1140 | 1142 | 1144 | 1146 | 1148 | 1150 | 1152 |
| H1H5777P | 1154 | 1156 | 1158 | 1160 | 1162 | 1164 | 1166 | 1168 |
| H1H5778P | 1170 | 1172 | 1174 | 1176 | 1178 | 1180 | 1182 | 1184 |
| H1H5780P | 1186 | 1188 | 1190 | 1192 | 1194 | 1196 | 1198 | 1200 |
| H1H5781P | 1202 | 1204 | 1206 | 1208 | 1210 | 1212 | 1214 | 1216 |
| H1H5782P | 1218 | 1220 | 1222 | 1224 | 1226 | 1228 | 1230 | 1232 |
| H1H5785B | 1234 | 1236 | 1238 | 1240 | 1242 | 1244 | 1246 | 1248 |
| H1H5786B | 1250 | 1252 | 1254 | 1256 | 1258 | 1260 | 1262 | 1264 |
| H1H5788P | 1266 | 1268 | 1270 | 1272 | 1274 | 1276 | 1278 | 1280 |
| H1H5790B | 1282 | 1284 | 1286 | 1288 | 1290 | 1292 | 1294 | 1296 |
| H1H5791B | 1298 | 1300 | 1302 | 1304 | 1306 | 1308 | 1310 | 1312 |
| H1H5792B | 1314 | 1316 | 1318 | 1320 | 1322 | 1324 | 1326 | 1328 |
| H1H5793B | 1330 | 1332 | 1334 | 1336 | 1338 | 1340 | 1342 | 1344 |
| H1H5795B | 1346 | 1348 | 1350 | 1352 | 1354 | 1356 | 1358 | 1360 |
| H1H5796B | 1362 | 1364 | 1366 | 1368 | 1370 | 1372 | 1374 | 1376 |

TABLE 16-continued

Amino Acid Sequence Identifiers

| Antibody Designation | SEQ ID NOs: | | | | | | | |
|---|---|---|---|---|---|---|---|---|
| | HCVR | HCDR1 | | HCDR3 | LCVR | LCDR11 | LCDR2 | LCDR3 |
| H1H5797B | 1378 | 1380 | 1382 | 1384 | 1386 | 1388 | 1390 | 1392 |
| H1H5798B | 1394 | 1396 | 1398 | 1400 | 1402 | 1404 | 1406 | 1408 |
| H1H5799P | 1410 | 1412 | 1414 | 1416 | 1418 | 1420 | 1422 | 1424 |
| H1H5801B | 1426 | 1428 | 1430 | 1432 | 1434 | 1436 | 1438 | 1440 |
| H1H7194B | 1442 | 1444 | 1446 | 1448 | 1634 | 1636 | 1638 | 1640 |
| H1H7195B | 1450 | 1452 | 1454 | 1456 | 1634 | 1636 | 1638 | 1640 |
| H1H7196B | 1458 | 1460 | 1462 | 1464 | 1634 | 1636 | 1638 | 1640 |
| H1H7198B | 1466 | 1468 | 1470 | 1472 | 1634 | 1636 | 1638 | 1640 |
| H1H7203B | 1474 | 1476 | 1478 | 1480 | 1634 | 1636 | 1638 | 1640 |
| H1H7204B | 1482 | 1484 | 1486 | 1488 | 1634 | 1636 | 1638 | 1640 |
| H1H7208B | 1490 | 1492 | 1494 | 1496 | 1634 | 1636 | 1638 | 1640 |
| H1H7211B | 1498 | 1500 | 1502 | 1504 | 1634 | 1636 | 1638 | 1640 |
| H1H7221B | 1506 | 1508 | 1510 | 1512 | 1634 | 1636 | 1638 | 1640 |
| H1H7223B | 1514 | 1516 | 1518 | 1520 | 1634 | 1636 | 1638 | 1640 |
| H1H7226B | 1522 | 1524 | 1526 | 1528 | 1634 | 1636 | 1638 | 1640 |
| H1H7232B | 1530 | 1532 | 1534 | 1536 | 1634 | 1636 | 1638 | 1640 |
| H1H7233B | 1538 | 1540 | 1542 | 1544 | 1634 | 1636 | 1638 | 1640 |
| H1H7241B | 1546 | 1548 | 1550 | 1552 | 1634 | 1636 | 1638 | 1640 |
| H1H7242B | 1554 | 1556 | 1558 | 1560 | 1634 | 1636 | 1638 | 1640 |
| H1H7250B | 1562 | 1564 | 1566 | 1568 | 1634 | 1636 | 1638 | 1640 |
| H1H7251B | 1570 | 1572 | 1574 | 1576 | 1634 | 1636 | 1638 | 1640 |
| H1H7254B | 1578 | 1580 | 1582 | 1584 | 1634 | 1636 | 1638 | 1640 |
| H1H7258B | 1586 | 1588 | 1590 | 1592 | 1634 | 1636 | 1638 | 1640 |
| H1H7269B | 1594 | 1596 | 1598 | 1600 | 1634 | 1636 | 1638 | 1640 |
| H1H7279B | 1602 | 1604 | 1606 | 1608 | 1634 | 1636 | 1638 | 1640 |
| H1xH7221G | 1610 | 1612 | 1614 | 1616 | 1634 | 1636 | 1638 | 1640 |
| H1xH7221G3 | 1618 | 1620 | 1622 | 1624 | 1634 | 1636 | 1638 | 1640 |
| H1xH7221G5 | 1626 | 1628 | 1630 | 1632 | 1634 | 1636 | 1638 | 1640 |

TABLE 17

Nucleic Acid Sequence Identifiers

| Antibody Designation | SEQ ID NOs: | | | | | | | |
|---|---|---|---|---|---|---|---|---|
| | HCVR | HCDR1 | HCDR2 | HCDR3 | LCVR | LCDR1 | LCDR2 | LCDR3 |
| H1H2712N | 401 | 403 | 405 | 407 | 409 | 411 | 413 | 415 |
| H1M2692N | 417 | 419 | 421 | 423 | 425 | 427 | 429 | 431 |
| H1M3542N | 433 | 435 | 437 | 439 | 441 | 443 | 445 | 447 |
| H1M3544N | 449 | 451 | 453 | 455 | 457 | 459 | 461 | 463 |
| H1M3549N | 465 | 467 | 469 | 471 | 473 | 475 | 477 | 479 |
| H1M3613N | 481 | 483 | 485 | 487 | 489 | 491 | 493 | 495 |
| H2M2689N | 497 | 499 | 501 | 503 | 505 | 507 | 509 | 511 |
| H2M2690N | 513 | 515 | 517 | 519 | 521 | 523 | 525 | 527 |
| H2M2691N | 529 | 531 | 533 | 535 | 537 | 539 | 541 | 543 |
| H2M2704N | 545 | 547 | 549 | 551 | 553 | 555 | 557 | 559 |
| H2M2705N | 561 | 563 | 565 | 567 | 569 | 571 | 573 | 575 |
| H2M2706N | 577 | 579 | 581 | 583 | 585 | 587 | 589 | 591 |
| H2M2707N | 593 | 595 | 597 | 599 | 601 | 603 | 605 | 607 |
| H2M2708N | 609 | 611 | 613 | 615 | 617 | 619 | 621 | 623 |
| H2M2709N | 625 | 627 | 629 | 631 | 633 | 635 | 637 | 639 |
| H2M2710N | 641 | 643 | 645 | 647 | 649 | 651 | 653 | 655 |
| H2M2711N | 657 | 659 | 661 | 663 | 665 | 667 | 669 | 671 |
| H2M2774N | 673 | 675 | 677 | 679 | 681 | 683 | 685 | 687 |
| H2M2775N | 689 | 691 | 693 | 695 | 697 | 699 | 701 | 703 |
| H2M2776N | 705 | 707 | 709 | 711 | 713 | 715 | 717 | 719 |
| H2M2777N | 721 | 723 | 725 | 727 | 729 | 731 | 733 | 735 |
| H2M2778N | 737 | 739 | 741 | 743 | 745 | 747 | 749 | 751 |
| H2M2779N | 753 | 755 | 757 | 759 | 761 | 763 | 765 | 767 |
| H2M2789N | 769 | 771 | 773 | 775 | 777 | 779 | 781 | 783 |
| H2M2862N | 785 | 787 | 789 | 791 | 793 | 795 | 797 | 799 |
| H2M2885N | 801 | 803 | 805 | 807 | 809 | 811 | 813 | 815 |
| H2M2886N | 817 | 819 | 821 | 823 | 825 | 827 | 829 | 831 |
| H2M3540N | 833 | 835 | 837 | 839 | 841 | 843 | 845 | 847 |
| H2M3541N | 849 | 851 | 853 | 855 | 857 | 859 | 861 | 863 |
| H2M3543N | 865 | 867 | 869 | 871 | 873 | 875 | 877 | 879 |
| H2M3547N | 881 | 883 | 885 | 887 | 889 | 891 | 893 | 895 |
| H2M3548N | 897 | 899 | 901 | 903 | 905 | 907 | 909 | 911 |
| H2M3563N | 913 | 915 | 917 | 919 | 921 | 923 | 925 | 927 |
| H1H5751P | 929 | 931 | 933 | 935 | 937 | 939 | 941 | 943 |

TABLE 17-continued

Nucleic Acid Sequence Identifiers

| Antibody Designation | HCVR | HCDR1 | HCDR2 | HCDR3 | LCVR | LCDR1 | LCDR2 | LCDR3 |
|---|---|---|---|---|---|---|---|---|
| H1H5752P | 945 | 947 | 949 | 951 | 953 | 955 | 957 | 959 |
| H1H5753B | 961 | 963 | 965 | 967 | 969 | 971 | 973 | 975 |
| H1H5754B | 977 | 979 | 981 | 983 | 985 | 987 | 989 | 991 |
| H1H5755B | 993 | 995 | 997 | 999 | 1001 | 1003 | 1005 | 1007 |
| H1H5756B | 1009 | 1011 | 1013 | 1015 | 1017 | 1019 | 1021 | 1023 |
| H1H5757B | 1025 | 1027 | 1029 | 1031 | 1033 | 1035 | 1037 | 1039 |
| H1H5758B | 1041 | 1043 | 1045 | 1047 | 1049 | 1051 | 1053 | 1055 |
| H1H5761P | 1057 | 1059 | 1061 | 1063 | 1065 | 1067 | 1069 | 1071 |
| H1H5763P | 1073 | 1075 | 1077 | 1079 | 1081 | 1083 | 1085 | 1087 |
| H1H5764P | 1089 | 1091 | 1093 | 1095 | 1097 | 1099 | 1101 | 1103 |
| H1H5769P | 1105 | 1107 | 1109 | 1111 | 1113 | 1115 | 1117 | 1119 |
| H1H5771P | 1121 | 1123 | 1125 | 1127 | 1129 | 1131 | 1133 | 1135 |
| H1H5772P | 1137 | 1139 | 1141 | 1143 | 1145 | 1147 | 1149 | 1151 |
| H1H5777P | 1153 | 1155 | 1157 | 1159 | 1161 | 1163 | 1165 | 1167 |
| H1H5778P | 1169 | 1171 | 1173 | 1175 | 1177 | 1179 | 1181 | 1183 |
| H1H5780P | 1185 | 1187 | 1189 | 1191 | 1193 | 1195 | 1197 | 1199 |
| H1H5781P | 1201 | 1203 | 1205 | 1207 | 1209 | 1211 | 1213 | 1215 |
| H1H5782P | 1217 | 1219 | 1221 | 1223 | 1225 | 1227 | 1229 | 1231 |
| H1H5785B | 1233 | 1235 | 1237 | 1239 | 1241 | 1243 | 1245 | 1247 |
| H1H5786B | 1249 | 1251 | 1253 | 1255 | 1257 | 1259 | 1261 | 1263 |
| H1H5788P | 1265 | 1267 | 1269 | 1271 | 1273 | 1275 | 1277 | 1279 |
| H1H5790B | 1281 | 1283 | 1285 | 1287 | 1289 | 1291 | 1293 | 1295 |
| H1H5791B | 1297 | 1299 | 1301 | 1303 | 1305 | 1307 | 1309 | 1311 |
| H1H5792B | 1313 | 1315 | 1317 | 1319 | 1321 | 1323 | 1325 | 1327 |
| H1H5793B | 1329 | 1331 | 1333 | 1335 | 1337 | 1339 | 1341 | 1343 |
| H1H5795B | 1345 | 1347 | 1349 | 1351 | 1353 | 1355 | 1357 | 1359 |
| H1H5796B | 1361 | 1363 | 1365 | 1367 | 1369 | 1371 | 1373 | 1375 |
| H1H5797B | 1377 | 1379 | 1381 | 1383 | 1385 | 1387 | 1389 | 1391 |
| H1H5798B | 1393 | 1395 | 1397 | 1399 | 1401 | 1403 | 1405 | 1407 |
| H1H5799P | 1409 | 1411 | 1413 | 1415 | 1417 | 1419 | 1421 | 1423 |
| H1H5801B | 1425 | 1427 | 1429 | 1431 | 1433 | 1435 | 1437 | 1439 |
| H1H7194B | 1441 | 1443 | 1445 | 1447 | 1633 | 1635 | 1637 | 1639 |
| H1H7195B | 1449 | 1451 | 1453 | 1455 | 1633 | 1635 | 1637 | 1639 |
| H1H7196B | 1457 | 1459 | 1461 | 1463 | 1633 | 1635 | 1637 | 1639 |
| H1H7198B | 1465 | 1467 | 1469 | 1471 | 1633 | 1635 | 1637 | 1639 |
| H1H7203B | 1473 | 1475 | 1477 | 1479 | 1633 | 1635 | 1637 | 1639 |
| H1H7204B | 1481 | 1483 | 1485 | 1487 | 1633 | 1635 | 1637 | 1639 |
| H1H7208B | 1489 | 1491 | 1493 | 1495 | 1633 | 1635 | 1637 | 1639 |
| H1H7211B | 1497 | 1499 | 1501 | 1503 | 1633 | 1635 | 1637 | 1639 |
| H1H7221B | 1505 | 1507 | 1509 | 1511 | 1633 | 1635 | 1637 | 1639 |
| H1H7223B | 1513 | 1515 | 1517 | 1519 | 1633 | 1635 | 1637 | 1639 |
| H1H7226B | 1521 | 1523 | 1525 | 1527 | 1633 | 1635 | 1637 | 1639 |
| H1H7232B | 1529 | 1531 | 1533 | 1535 | 1633 | 1635 | 1637 | 1639 |
| H1H7233B | 1537 | 1539 | 1541 | 1543 | 1633 | 1635 | 1637 | 1639 |
| H1H7241B | 1545 | 1547 | 1549 | 1551 | 1633 | 1635 | 1637 | 1639 |
| H1H7242B | 1553 | 1555 | 1557 | 1559 | 1633 | 1635 | 1637 | 1639 |
| H1H7250B | 1561 | 1563 | 1565 | 1567 | 1633 | 1635 | 1637 | 1639 |
| H1H7251B | 1569 | 1571 | 1573 | 1575 | 1633 | 1635 | 1637 | 1639 |
| H1H7254B | 1577 | 1579 | 1581 | 1583 | 1633 | 1635 | 1637 | 1639 |
| H1H7258B | 1585 | 1587 | 1589 | 1591 | 1633 | 1635 | 1637 | 1639 |
| H1H7269B | 1593 | 1595 | 1597 | 1599 | 1633 | 1635 | 1637 | 1639 |
| H1H7279B | 1601 | 1603 | 1605 | 1607 | 1633 | 1635 | 1637 | 1639 |
| H1xH7221G | 1609 | 1611 | 1613 | 1615 | 1633 | 1635 | 1637 | 1639 |
| H1xH7221G3 | 1617 | 1619 | 1621 | 1623 | 1633 | 1635 | 1637 | 1639 |
| H1xH7221G5 | 1625 | 1627 | 1629 | 1631 | 1633 | 1635 | 1637 | 1639 |

Antibodies are typically referred to herein according to the following nomenclature: Fc prefix (e.g. "H1H," "H1M," "H2M," etc.), followed by a numerical identifier (e.g. "2712," "2692," etc., as shown in Table 1), followed by a "P," "N," or "B" suffix. Thus, according to this nomenclature, an antibody may be referred to herein as, e.g., "H1H2712N," "H1M2692N," "H2M2689N," etc. The H1H, H1M and H2M prefixes on the antibody designations used herein indicate the particular Fc region isotype of the antibody. For example, an "H1H" antibody has a human IgG1 Fc, an "H1M" antibody has a mouse IgG1 Fc, and an "H2M" antibody has a mouse IgG2 Fc, (all variable regions are fully human as denoted by the first 'H' in the antibody designation). As will be appreciated by a person of ordinary skill in the art, an antibody having a particular Fc isotype can be converted to an antibody with a different Fc isotype (e.g., an antibody with a mouse IgG1 Fc can be converted to an antibody with a human IgG4, etc.), but in any event, the variable domains (including the CDRs)—which are indicated by the numerical identifiers shown in Table 1—will remain the same, and the binding properties are expected to be identical or substantially similar regardless of the nature of the Fc domain.

Tables 18 and 19 set out the amino acid sequence identifiers for heavy chain variable regions (Table 18) and light chain variable regions (Table 19), and their corresponding CDRs, of additional anti-CD3 HCVRs and LCVRs useful in anti-MUC16×anti-CD3 bispecific antibodies of the invention.

TABLE 18

(Heavy Chain Variable Region Amino Acid Sequences)

| Heavy Chain Identifier | SEQ ID NOs | | | |
|---|---|---|---|---|
| | HCVR | HCDR1 | HCDR2 | HCDR3 |
| CD3-VH-AA | 1642 | 1644 | 1646 | 1648 |
| CD3-VH-B | 1658 | 1660 | 1662 | 1664 |
| CD3-VH-C | 1674 | 1676 | 1678 | 1680 |
| CD3-VH-D | 1690 | 1692 | 1694 | 1696 |
| CD3-VH-E | 1706 | 1708 | 1710 | 1712 |
| CD3-VH-F# | 1721 | 1722 | 1723 | 1724 |

TABLE 19

(Light Chain Variable Region Amino Acid Sequences)

| Light Chain Identifier | SEQ ID NOs | | | |
|---|---|---|---|---|
| | LCVR | LCDR1 | LCDR2 | LCDR3 |
| CD3-VL-AA | 1650 | 1652 | 1654 | 1656 |
| CD3-VL-B | 1666 | 1668 | 1670 | 1672 |
| CD3-VL-C | 1682 | 1684 | 1686 | 1688 |
| CD3-VL-D | 1698 | 1700 | 1702 | 1704 |
| CD3-VL-E | 1714 | 1716 | 1718 | 1720 |
| CD3-VL-F# | 1725 | 1726 | 1727 | 1728 |

The heavy and light chain variable regions of CD3-VH-F and CD3-VL-F were derived from the anti-CD3 antibody designated "L2K" as set forth in WO2004/106380.

In addition, Tables 20 and 21 set out the sequence identifiers for the nucleotide sequences encoding the heavy chain variable regions (Table 20) and light chain variable regions (Table 21), and their corresponding CDRs, of additional anti-CD3 HCVRs and LCVRs useful in anti-MUC16× anti-CD3 bispecific antibodies of the invention.

TABLE 20

(Nucleotide Sequences Encoding Heavy Chain Variable Region Sequences)

| Heavy Chain Identifier | SEQ ID NOs | | | |
|---|---|---|---|---|
| | HCVR | HCDR1 | HCDR2 | HCDR3 |
| CD3-VH-AA | 1641 | 1643 | 1645 | 1647 |
| CD3-VH-B | 1657 | 1659 | 1661 | 1663 |
| CD3-VH-C | 1673 | 1675 | 1677 | 1679 |
| CD3-VH-D | 1689 | 1691 | 1693 | 1695 |
| CD3-VH-E | 1705 | 1707 | 1709 | 1711 |

TABLE 21

(Nucleotide Sequences Encoding Light Chain Variable Region Sequences)

| Light Chain Identifier | SEQ ID NOs | | | |
|---|---|---|---|---|
| | LCVR | LCDR1 | LCDR2 | LCDR3 |
| CD3-VL-AA | 1649 | 1651 | 1653 | 1655 |
| CD3-VL-B | 1665 | 1667 | 1669 | 1671 |
| CD3-VL-C | 1681 | 1683 | 1685 | 1687 |

TABLE 21-continued (Nucleotide Sequences Encoding Light Chain Variable Region Sequences)

| Light Chain Identifier | SEQ ID NOs | | | |
|---|---|---|---|---|
| | LCVR | LCDR1 | LCDR2 | LCDR3 |
| CD3-VL-D | 1697 | 1699 | 1701 | 1703 |
| CD3-VL-E | 1713 | 1715 | 1717 | 1719 |

Control Constructs Used in the Following Examples

Various control constructs (anti-CD3 antibodies) were included in the following experiments for comparative purposes: "OKT-3," a mouse monoclonal antibody against human T-cell surface antigens available from the American Type Culture Collection (ATCC) under catalog no. CRL-8001; and "SP34," a commercially available mouse monoclonal antibody obtained, e.g., from Biolegend, San Diego, Calif. (Cat. No. 302914) or BD Pharmagen, Cat. 55052, reactive against the epsilon chain of the T3 complex on human T lymphocyte cells.

Example 13: Generation of Additional Anti-CD3 Antibodies

The following procedures were aimed at identifying antibodies that specifically recognized CD3 (T cell co-receptor) as an antigen.

A pool of anti-CD3 antibodies were derived from a genetically modified mouse. Briefly, mice were immunized with a CD3 antigen and generated B cells that comprised a diversity of human VH rearrangements in order to express a diverse repertoire of high-affinity antigen-specific antibodies. Antibodies described in Tables 22-25 have the same light chain sequence of VK1-39JK5 (LCVR set forth in SEQ ID NO: 1890).

Generated antibodies were tested for binding to human and cynomolgus monkey CD3 antigen in an in vitro binding assay, and e.g. one CD3 antibody: designated CD3-VH-P (HCVR set forth in SEQ ID NO: 1882) was identified, amongst a few others, that were found to bind to both human and cynomolgus CD3 having an $EC_{50}$ between 1 and 40 nM binding (or cell binding titration), as determined in a FACS titration of Jurkat cells and cynomolgus T cells, respectively. See also, e.g., FACS binding experiments outlined in Example 15 and in PCT/US2016/044732 filed Jul. 29, 2016.

The germline amino acid residues of CD3-VH-P were subsequently identified (V-D-J rearrangement for CD3-VH-P is IGHV3-9*01, IGHJ6*02, IGHD5-12*01) and an antibody designated "CD3-VH-G" was engineered to contain only germline frameworks. Other antibody derivatives were engineered by well-known molecular cloning techniques to replace amino acid residues in a stepwise manner based on differences between the germline sequence and the CD3-VH-P sequence. Each antibody derivative is given a "CD3-VH-G" number designation. See Table 18.

While CD3-VH-G and some other engineered antibodies retained their binding as seen in the FACS assays, several anti-CD3 antibodies bound to human or cynomolgus CD3 in vitro with weak to no measurable binding, such as 40 nM EC50. Binding affinities, binding kinetics, and other biological properties to elucidate toxicity and pharmacokinetic (pK) profiles were subsequently investigated for bispecific antibodies comprising the exemplary anti-CD3 antibodies generated in accordance with the methods of this Example, are described in detail in the Examples herein.

Example 14: Heavy and Light Chain Variable Regions (Amino Acid and Nucleic Acid Sequences of the CDRs)

Table 22 sets forth the amino acid sequence identifiers of the heavy chain variable regions and CDRs of selected anti-CD3 antibodies of the invention. The corresponding nucleic acid sequence identifiers are set forth in Table 23.

Amino acid and nucleic acid sequences were determined for each antibody heavy chain sequence. Each antibody heavy chain derived from the germline sequence (SEQ ID NO: 1910) was assigned a "G" number designation for consistent nomenclature. Table 22 sets forth the amino acid sequence identifiers of the heavy chain variable regions and CDRs of engineered anti-CD3 antibodies of the invention. The corresponding nucleic acid sequence identifiers are set forth in Table 23. The amino acid and nucleic acid sequence identifiers of the light chain variable region and CDRs are also identified below in Tables 24 and 25, respectively.

TABLE 22

Heavy Chain Amino Acid Sequence Identifiers

| Antibody CD3-VH Designation | SEQ ID NOs: | | | |
|---|---|---|---|---|
| | HCVR | CDR1 | CDR2 | CDR3 |
| CD3-VH-G | 1730 | 1732 | 1734 | 1736 |
| CD3-VH-G2 | 1738 | 1740 | 1742 | 1744 |
| CD3-VH-G3 | 1746 | 1748 | 1750 | 1752 |
| CD3-VH-G4 | 1754 | 1756 | 1758 | 1760 |
| CD3-VH-G5 | 1762 | 1764 | 1766 | 1768 |
| CD3-VH-G8 | 1770 | 1772 | 1774 | 1776 |
| CD3-VH-G9 | 1778 | 1780 | 1782 | 1784 |
| CD3-VH-G10 | 1786 | 1788 | 1790 | 1792 |
| CD3-VH-G11 | 1794 | 1796 | 1798 | 1800 |
| CD3-VH-G12 | 1802 | 1804 | 1806 | 1808 |
| CD3-VH-G13 | 1810 | 1812 | 1814 | 1816 |
| CD3-VH-G14 | 1818 | 1820 | 1822 | 1824 |
| CD3-VH-G15 | 1826 | 1828 | 1830 | 1832 |
| CD3-VH-G16 | 1834 | 1836 | 1838 | 1840 |
| CD3-VH-G17 | 1842 | 1844 | 1846 | 1848 |
| CD3-VH-G18 | 1850 | 1852 | 1854 | 1856 |
| CD3-VH-G19 | 1858 | 1860 | 1862 | 1864 |
| CD3-VH-G20 | 1866 | 1868 | 1870 | 1872 |
| CD3-VH-G21 | 1874 | 1876 | 1878 | 1880 |
| CD3-VH-P | 1882 | 1884 | 1886 | 1888 |

TABLE 23

Heavy Chain Nucleic Acid Sequence Identifiers

| Antibody CD3-VH Designation | SEQ ID NOs: | | | |
|---|---|---|---|---|
| | HCVR | CDR1 | CDR2 | CDR3 |
| CD3-VH-G | 1729 | 1731 | 1733 | 1735 |
| CD3-VH-G2 | 1737 | 1739 | 1741 | 1743 |
| CD3-VH-G3 | 1745 | 1747 | 1749 | 1751 |
| CD3-VH-G4 | 1753 | 1755 | 1757 | 1759 |
| CD3-VH-G5 | 1761 | 1763 | 1765 | 1767 |
| CD3-VH-G8 | 1769 | 1771 | 1773 | 1775 |
| CD3-VH-G9 | 1777 | 1779 | 1781 | 1783 |
| CD3-VH-G10 | 1785 | 1787 | 1789 | 1791 |
| CD3-VH-G11 | 1793 | 1795 | 1797 | 1799 |
| CD3-VH-G12 | 1801 | 1803 | 1805 | 1807 |
| CD3-VH-G13 | 1809 | 1811 | 1813 | 1815 |
| CD3-VH-G14 | 1817 | 1819 | 1821 | 1823 |
| CD3-VH-G15 | 1825 | 1827 | 1829 | 1831 |
| CD3-VH-G16 | 1833 | 1835 | 1837 | 1839 |
| CD3-VH-G17 | 1841 | 1843 | 1845 | 1847 |
| CD3-VH-G18 | 1849 | 1851 | 1853 | 1855 |

TABLE 23-continued

Heavy Chain Nucleic Acid Sequence Identifiers

| Antibody CD3-VH Designation | SEQ ID NOs: | | | |
|---|---|---|---|---|
| | HCVR | CDR1 | CDR2 | CDR3 |
| CD3-VH-G19 | 1857 | 1859 | 1861 | 1863 |
| CD3-VH-G20 | 1865 | 1867 | 1869 | 1871 |
| CD3-VH-G21 | 1873 | 1875 | 1877 | 1879 |
| CD3-VH-P | 1881 | 1883 | 1885 | 1887 |

TABLE 24

Light Chain Amino Acid Sequence Identifiers

| Antibody Designation | SEQ ID NOs: | | | |
|---|---|---|---|---|
| | LCVR | CDR1 | CDR2 | CDR3 |
| VK1-39JK5 | 1890 | 1892 | 1894 | 1896 |

TABLE 25

Light Chain Nucleic Acid Sequence Identifiers

| Antibody Designation | SEQ ID NOs: | | | |
|---|---|---|---|---|
| | LCVR | CDR1 | CDR2 | CDR3 |
| VK1-39JK5 | 1889 | 1891 | 1893 | 1895 |

Control 1 antibody designated "CD3-L2K" was constructed based on a known anti-CD3 antibody (i.e., the anti-CD3 antibody "L2K" as set forth in WO2004/106380).

Isotype Control Antibody, referred to in the Examples herein, is an isotype matched (modified IgG4) antibody that interacts with an irrelevant antigen, i.e. FelD1 antigen.

Example 15: In Vitro and In Vivo Studies on Human Monoclonal Anti-CD3 Antibodies In vivo and in vitro studies on human monoclonal anti-CD3 antibodies were done as described in US publication 2014/0088295 published Mar. 27, 2014, and PCT/US2016/044732 filed Jul. 29, 2016, which are hereby incorporated by reference.

Some human monoclonal anti-CD3 antibodies of the present invention bind soluble heterodimeric CD3 protein, in either antibody-capture or antigen-capture formats, with high affinity. Soluble heterodimeric CD3 protein (hCD3-epsilon/hCD3-delta; SEQ ID NOs: 1900/1901) was prepared with either a human Fc tag (hFcΔAdp/hFc; SEQ ID NOs: 1931/1932) or a mouse Fc tag (mFcΔAdp/mFc; SEQ ID NOs: 1933/1934). Heterodimeric CD3 protein was purified using the method described in Davis et al. (US2010/0331527).

Some human monoclonal anti-CD3 antibodies of the invention bound human T-cells and induced T-cell proliferation. Some human monoclonal anti-CD3 antibodies of the invention bound CD2+CD4+ monkey T-cells and induced their proliferation. Some human monoclonal anti-CD3 antibodies supported redirected T-cell mediated killing via Fc/FcR interaction in a calcein based U937 killing assay. The observed killing, believed to be dependent on the antibody's Fc engagement with the Fc Receptor on U937 cells leading to clustering of CD3 on adjacent T-cells, was squelched by addition of non-specific human IgG (data not shown). A wide range of bispecific antibodies constructed with anti-CD3 arm variants described herein (particularly anti-CD3 arms based on the CD3-VH-P heavy chain derived from IGHV3-9*01, IGHJ6*02, IGHD5-12*01) activate human PBMC cells, and monkey PBMCs, and display cytotoxic activity on tumor antigen-expressing cell lines.

Example 16: Screening and Identification of Anti-MUC16 Monoclonal Antibodies Suitable for Immunohistochemistry (IHC) on Formalin Fixed Paraffin Embedded (FFPE) Samples Human tumor cell lines with known levels of expression of MUC16 were identified, fixed in 10% Neutral Buffered Formalin and embedded in paraffin. These lines were used to screen various anti-MUC16 antibodies to identify candidates for IHC studies.

Cell lines included the following MUC16 Negative cell lines: HT29 (Colon), and PC3/ATCC parental (Prostate); Pancreatic cell lines with low to no levels of MUC16: Capan1 (Pancreatic adenocarcinoma), HPAC (Pancreatic adenocarcinoma). Endogenously MUC16-expressing cell lines include: OVCAR3 (Ovarian) and PEO-1 (Serous ovarian carcinoma).

Transfected cell lines were engineered as follows: PC3/ATCC (parental Prostate cancer line) cells were transfected to generate PC3/MUC16 "short" and PC3/MUC16 "high" cell lines. Both constructs include the C-terminal domain of MUC16 from amino acids 13,810-14,507 (of SEQ ID NO: 1899), and this includes part of the SEA12 domain, SEA13, SEA14, SEA15, SEA16, the C-terminal non-SEA region, the transmembrane region and the cytoplasmic domain. In addition, the PC3/MUC high cells have additional N-terminal amino acids 12783-13467 (of SEQ ID NO: 1899) which include SEA5 (partial) through SEA9 and a short linker between the SEA9 domain and the start of the MUC16 short construct. This allows for differentiation between anti-MUC16 antibodies that bind in the repeat region and those that bind to the "nub" portion of MUC16 adjacent to the membrane following enzymatic cleavage and release of the repeat regions (analogous to the CA125 portion of MUC16).

All staining was performed on the Ventana Discovery XT autostainer using standard protocols. Cell pellets were deparaffinized, Heat Induced Epitope Retrieval was optimized, endogenous Biotin was blocked and Protein blocking was performed. The antibodies were applied manually at an initial concentration of 10 µg/ml and were also titrated down to ensure the specificity of the signal. Comparison was made against a commercially available anti-MUC16 antibody (OC-125), which is specific for the repeat regions of CA-125 (Roche, Ventana Catalog #760-2610), and a negative control (absence of primary antibody). Detection was with Donkey anti-mouse-Biotin followed by Streptavidin-Horseradish peroxidase. The conversion of the substrate, Di-amino Benzidine (DAB) was observed as brown staining. Samples were counterstained with hematoxylin to visualize the nuclei. The results of the staining experiments are presented in Table 26, below.

TABLE 26

Binding of anti-MUC16 Antibodies to MUC16-negative Cells, and Cells Expressing MUC16 or Membrane-Proximal Portions of MUC16

| Cell line: | HT29 | Capan1 | HPAC | OVCAR3 | PEO-1 | PC3/ATCC parental | PC3/MUC16 Short | PC3/MUC16 High |
|---|---|---|---|---|---|---|---|---|
| H1M7130N | − | − | − | +++ | ++ | − | +++ | +++ |
| H2aM7128N | − | − | + | +++ | ++ | − | +++ | +++ |
| H2aM7131N | − | − | − | +++ | ++ | − | +++ | +++ |
| H2aM7133N | − | − | − | +++ | ++ | − | − | − |
| H2aM7138N | − | − | + | +++ | ++ | − | +++ | +++ |
| H1M9519N | − | NT | NT | +++ | +++ | NT | − | +++ |
| H3M9525N | − | NT | NT | − | − | NT | − | − |
| OC-125 | − | − | + | +++ | ++ | − | − | +++ |
| Neg. Control | − | − | − | − | − | − | − | − |

NT—not tested

Four of the tested antibodies (H1M7130N, H2aM7128N, H2aM7131N and H2aM7138N) showed positive binding to cells expressing the "nub" portion of MUC16 without the repeat regions (PC3/MUC16 short). These antibodies are identified as "nub binders." One of the tested antibodies (H1M9519N) showed positive binding to cells expressing the repeat regions of MUC16 (PC3/MUC16 high), but negative binding to cells expressing only the "nub" portion of MUC16 (PC3/MUC16 short). This antibody is identified as a "repeat binder," similar to the commercially available OC-125 antibody. It is expected that the tested antibodies bind tissues or cells of different origin having the expressed proteins and/or protein fragments as described herein.

The present invention is not to be limited in scope by the specific embodiments described herein. Indeed, various modifications of the invention in addition to those described herein will become apparent to those skilled in the art from the foregoing description. Such modifications are intended to fall within the scope of the appended claims.

SEQUENCE LISTING (1962 sequences)

SEQ ID NO: 1 - DNA, 366 bp, Artificial Sequence
  Synthetic
gaagtgcagctggtggagtctgggggaggcttggtacagcctggcaggtccctgagactctcctgtgcagcctctggattcacatttaatgattatgccatgcactgggtccggcaaagtccagggaagggcctggagtgggtctcaggtattgattggaatggtggtagtatagactatgcggactctgtgaagggccgattcaccatctccagagacaccgccaagaattccctatatctgcaaatgaacagtctgaaagttgaggacacggccttgtattactgtgcaaaagatatagggcactggaactatatcggcggaatggatgtctggggccaagggaccacggtcaccgtctcctca

SEQ ID NO: 2 - protein, 122 aa, Artificial Sequence
  Synthetic
EVQLVESGGGLVQPGRSLRLSCAASGFTFNDYAMHWVRQSPGKGLEWVSGIDWNGGSIDYADSVKGRFTISRDTAKNSLYLQMNSLKVEDTALYYCAKDIGHWNYIGGMDVWGQGTTVTVSS

SEQ ID NO: 3 - DNA, 24 bp, Artificial Sequence
  Synthetic
ggattcacatttaatgattatgcc

SEQ ID NO: 4 - protein, 8 aa, Artificial Sequence
  Synthetic
GFTFNDYA

SEQ ID NO: 5 - DNA, 24 bp, Artificial Sequence
  Synthetic
attgattggaatggtggtagtata

SEQ ID NO: 6 - protein, 8 aa, Artificial Sequence
  Synthetic
IDWNGGSI

SEQ ID NO: 7 - DNA, 45 bp, Artificial Sequence
  Synthetic
gcaaaagatatagggcactggaactatatcggcggaatggatgtc

SEQ ID NO: 8 - protein, 15 aa, Artificial Sequence
  Synthetic
AKDIGHWNYIGGMDV

SEQ ID NO: 9 - DNA, 324 bp, Artificial Sequence
  Synthetic
gacatccagatgacccagtctccatcctccctgtctgcatctgtaggagacagagtcaccatcacttgccgggcaagtcagagcattaacatctatttaaattggtatcagcagaaaccagggaaagcccctaagttcctgatctatgctgcatccagtttacaaactggggtcccatcaaggttcagtggcagtggatctgggacagatttcactctcaccatcagcagtctggaacctgaagattttgcaacttactactgtcaacacagttacagtacccctccgatcaccttcggccaagggacacgactggagattaaa

SEQ ID NO: 10 - protein, 108 aa, Artificial Sequence
  Synthetic
DIQMTQSPSSLSASVGDRVTITCRASQSINIYLNWYQQKPGKAPKFLIYAASSLQTGVPSRFSGSGSGTDFTLTISSLEPEDFATYYCQHSYSTPPITFGQGTRLEIK

SEQ ID NO: 11 - DNA, 18 bp, Artificial Sequence
  Synthetic
cagagcattaacatctat

SEQ ID NO: 12 - protein, 6 aa, Artificial Sequence
  Synthetic
QSINIY

SEQ ID NO: 13 - DNA, 9 bp, Artificial Sequence
  Synthetic
gctgcatcc

SEQ ID NO: 14 - protein, 3 aa, Artificial Sequence
  Synthetic
AAS

SEQ ID NO: 15 - DNA, 30 bp, Artificial Sequence
  Synthetic
caacacagttacagtacccctccgatcacc

SEQ ID NO: 16 - protein, 10 aa, Artificial Sequence
  Synthetic
QHSYSTPPIT

SEQ ID NO: 17 - DNA, 351 bp, Artificial Sequence
  Synthetic
caggtgcagctggtggagtctgggggaggcttggtcaagcctggagggtccctgagactctcctgtgcagcctctggattcaccttcagtaactactacatgagctgggtccgccaggctccagggaagggcctggagtggatttcctacattagtggtaggggtagtaccatattctacgcagactctgtgaagggccgaatcaccatctccagggacaacgccaagaactcactgtttctgcaaatgaacagcctgagagccgaggacacggccgtgtatttttgtgtgaaagatcggggtggatacagtccctactggggccagggaaccctggtcaccgtctcctca

SEQ ID NO: 18 - protein, 117 aa, Artificial Sequence
  Synthetic
QVQLVESGGGLVKPGGSLRLSCAASGFTFSNYYMSWVRQAPGKGLEWISYISGRGSTIFYADSVKGRITISRDNAKNSLFLQMNSLRAEDTAVYFCVKDRGGYSPYWGQGTLVTVSS

SEQ ID NO: 19 - DNA, 24 bp, Artificial Sequence
  Synthetic
ggattcaccttcagtaactactac

SEQ ID NO: 20 - protein, 8 aa, Artificial Sequence
  Synthetic
GFTFSNYY

SEQ ID NO: 21 - DNA, 24 bp, Artificial Sequence
  Synthetic
attagtggtaggggtagtaccata

SEQ ID NO: 22 - protein, 8 aa, Artificial Sequence
  Synthetic
ISGRGSTI

SEQ ID NO: 23 - DNA, 30 bp, Artificial Sequence
  Synthetic
gtgaaagatcggggtggatacagtccctac

SEQ ID NO: 24 - protein, 10 aa, Artificial Sequence
  Synthetic
VKDRGGYSPY

SEQ ID NO: 25 - DNA, 324 bp, Artificial Sequence
  Synthetic
gacatccagatgacccagtctccatcctccctgtctgcatctgtaggagacagagtcaccatcacttgccgggcaagtcagagcattagcacctatttaaattggtatcagcagaaaccagggaaagcccctaagctcctgatctatactgcatccagtttgcagagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 26 - protein, 108 aa, Artificial Sequence
  Synthetic
DIQMTQSPSSLSASVGDRVTITCRASQSISTYLNWYQQKPGKAPKLLIYTASSLQSGVPSRFSGSGSGTDFTLTISSLQPEDFATYYCQQSYSTPPITFGQGTRLEIK

SEQ ID NO: 27 - DNA, 18 bp, Artificial Sequence
  Synthetic
cagagcattagcacctat

SEQ ID NO: 28 - protein, 6 aa, Artificial Sequence
  Synthetic
QSISTY

SEQ ID NO: 29 - DNA, 9 bp, Artificial Sequence
  Synthetic
actgcatcc

SEQ ID NO: 30 - protein, 3 aa, Artificial Sequence
  Synthetic
TAS

SEQ ID NO: 31 - DNA, 30 bp, Artificial Sequence
  Synthetic
caacagagttacagtacccctccgatcacc

SEQ ID NO: 32 - protein, 10 aa, Artificial Sequence
  Synthetic
QQSYSTPPIT

SEQ ID NO: 33 - DNA, 369 bp, Artificial Sequence
  Synthetic
caggtgcagctggtggagtctgggggaggcgtggtccagcctgggaggtccctgagactctcctgtgcagcctctggattcaccttcagtgaccatggcatgcactgggtccgccaggctccaggcaaggggctggagtgggtggcagttatatcatatcatggaagtaataaacactatgcagactccgtgaagggccgattcaccatctccagagacaattccaagaacgcgctgtatctacaaatgaacagcctgagacctgaggacacggctatgtattactgtgcgaaagacggctacgatttttggaatggttattctctctttgactactggggccagggaaccctggtcaccgtctcctca

SEQ ID NO: 34 - protein, 123 aa, Artificial Sequence
  Synthetic
QVQLVESGGGVVQPGRSLRLSCAASGFTFSDHGMHWVRQAPGKGLEWVAVISYHGSNKHYADSVKGRFTISRDNSKNALYLQMNSLRPEDTAMYYCAKDGYDFWNGYSLFDYWGQGTLVTVSS

SEQ ID NO: 35 - DNA, 24 bp, Artificial Sequence
  Synthetic
ggattcaccttcagtgaccatggc

SEQ ID NO: 36 - protein, 8 aa, Artificial Sequence
  Synthetic
GFTFSDHG

SEQ ID NO: 37 - DNA, 24 bp, Artificial Sequence
  Synthetic
atatcatatcatggaagtaataaa

SEQ ID NO: 38 - protein, 8 aa, Artificial Sequence
  Synthetic
ISYHGSNK

SEQ ID NO: 39 - DNA, 48 bp, Artificial Sequence
  Synthetic
gcgaaagacggctacgatttttggaatggttattctctctttgactac

SEQ ID NO: 40 - protein, 16 aa, Artificial Sequence
  Synthetic
AKDGYDFWNGYSLFDY

SEQ ID NO: 41 - DNA, 324 bp, Artificial Sequence
  Synthetic
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatactgcatccaatttgctaagtggggtcccatcaaggttcagtggcagtggatctgggacagatttcactctcaccatcagcagtctgcaacctgaagattttgcaacttactactgtcaacagagttacagtacccctccgatcaccttcggccaggggaccaagctggagatcaaa

SEQ ID NO: 42 - protein, 108 aa, Artificial Sequence
  Synthetic
DIQMTQSPSSLSASVGDRVTITCRASQSISNYLNWYQQKPGKAPKLLIYTASNLLSGVPSRFSGSGSGTDFTLTISSLQPEDFATYYCQQSYSTPPITFGQGTKLEIK

SEQ ID NO: 43 - DNA, 18 bp, Artificial Sequence
  Synthetic
cagagcattagcaactat

SEQ ID NO: 44 - protein, 6 aa, Artificial Sequence
  Synthetic
QSISNY

SEQ ID NO: 45 - DNA, 9 bp, Artificial Sequence
  Synthetic
actgcatcc

SEQ ID NO: 46 - protein, 3 aa, Artificial Sequence
  Synthetic
TAS

SEQ ID NO: 47 - DNA, 30 bp, Artificial Sequence; identical to SEQ ID NO: 31
  Synthetic

SEQ ID NO: 48 - protein, 10 aa, Artificial Sequence
  Synthetic
QQSYSTPPIT

SEQ ID NO: 49 - DNA, 369 bp, Artificial Sequence
  Synthetic
caggtgcagctggtggagtctgggggaggcgtggtccagcctgggaggtccctgagactctcctgtgcagcctctggattcaccttcagtgaccatgccatgcactgggtccgccaggctccaggcaaggggctggagtgggtggcagttatatcatatcatggaactgataaacagtatggagactccgtgaagggccgattcaccatctccagagacaattccaagaacgcgctgtatctgcaaatgaacagcctgagacctgaggacacggctatgtattactgtgcgaaagacggctacgatttttggaatgcttattctctctttgactattggggccagggaaccctggtcaccgtctcctca

SEQ ID NO: 50 - protein, 123 aa, Artificial Sequence
  Synthetic
QVQLVESGGGVVQPGRSLRLSCAASGFTFSDHAMHWVRQAPGKGLEWVAVISYHGTDKQYGDSVKGRFTISRDNSKNALYLQMNSLRPEDTAMYYCAKDGYDFWNAYSLFDYWGQGTLVTVSS

SEQ ID NO: 51 - DNA, 24 bp, Artificial Sequence
  Synthetic
ggattcaccttcagtgaccatgcc

SEQ ID NO: 52 - protein, 8 aa, Artificial Sequence
  Synthetic
GFTFSDHA

SEQ ID NO: 53 - DNA, 24 bp, Artificial Sequence
  Synthetic
atatcatatcatggaactgataaa

SEQ ID NO: 54 - protein, 8 aa, Artificial Sequence
  Synthetic
ISYHGTDK

SEQ ID NO: 55 - DNA, 48 bp, Artificial Sequence
  Synthetic
gcgaaagacggctacgatttttggaatgcttattctctctttgactat

SEQ ID NO: 56 - protein, 16 aa, Artificial Sequence
  Synthetic
AKDGYDFWNAYSLFDY

SEQ ID NO: 57 - DNA, 324 bp, Artificial Sequence
  Synthetic
gacatccagatgacccagtctccatcctccctgtctgcatctgtaggagacagagtcaccatcacttgccgggcaagtcagagcattagcaactatttaaattggtatcagcagaaaccagggaaagcccctaaactcctgatctatactgcatccagtttgctaagtggggtcccatcaaggttcagtggcagtggatctgggacagatttcactctcaccatcagcagtctgcaacctgaagattttgcaacttactactgtcaacagagttacagtacccctccgatcaccttcggccaggggacacgactggagattaaa

SEQ ID NO: 58 - protein, 108 aa, Artificial Sequence
  Synthetic
DIQMTQSPSSLSASVGDRVTITCRASQSISNYLNWYQQKPGKAPKLLIYTASSLLSGVPSRFSGSGSGTDFTLTISSLQPEDFATYYCQQSYSTPPITFGQGTRLEIK

SEQ ID NO: 59 - DNA, 18 bp, Artificial Sequence
  Synthetic
cagagcattagcaactat

SEQ ID NO: 60 - protein, 6 aa, Artificial Sequence
  Synthetic
QSISNY

SEQ ID NO: 61 - DNA, 9 bp, Artificial Sequence
  Synthetic
actgcatcc

SEQ ID NO: 62 - protein, 3 aa, Artificial Sequence
  Synthetic
TAS

SEQ ID NO: 63 - DNA, 30 bp, Artificial Sequence; identical to SEQ ID NO: 31
  Synthetic

SEQ ID NO: 64 - protein, 10 aa, Artificial Sequence
  Synthetic
QQSYSTPPIT

SEQ ID NO: 65 - DNA, 369 bp, Artificial Sequence
  Synthetic
gaggtgcagctggtggagtctgggggaggcttggtacagccgggggggtccctgagactctcctgtgaagcctctggattcacctttagtaattatgccatgagttgggtccgccaggctccagggaaggggttggagtgggtctcaggtatgagtggaagtggtacttacccatattacgcagactctgtgaagggccggttcaccatctccagagacaattccaagaatatgttgtatctgcaaatgaacagcctgagagtcaaagacacggccgtatattactgtgcgaaagacggggtggatacagctatgattcttgatacttttgatctctggggccaagggacaatggtcaccgtctcttca

SEQ ID NO: 66 - protein, 123 aa, Artificial Sequence
  Synthetic
EVQLVESGGGLVQPGGSLRLSCEASGFTFSNYAMSWVRQAPGKGLEWVSGMSGSGTYPYYADSVKGRFTISRDNSKNMLYLQMNSLRVKDTAVYYCAKDGVDTAMILDTFDLWGQGTMVTVSS

SEQ ID NO: 67 - DNA, 24 bp, Artificial Sequence
  Synthetic
ggattcacctttagtaattatgcc

SEQ ID NO: 68 - protein, 8 aa, Artificial Sequence
  Synthetic
GFTFSNYA

SEQ ID NO: 69 - DNA, 24 bp, Artificial Sequence
  Synthetic
atgagtggaagtggtacttaccca

SEQ ID NO: 70 - protein, 8 aa, Artificial Sequence
  Synthetic
MSGSGTYP

SEQ ID NO: 71 - DNA, 48 bp, Artificial Sequence
  Synthetic
gcgaaagacggggtggatacagctatgattcttgatacttttgatctc

SEQ ID NO: 72 - protein, 16 aa, Artificial Sequence
  Synthetic
AKDGVDTAMILDTFDL

SEQ ID NO: 73 - DNA, 324 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggaccaagctggagatcaaa

SEQ ID NO: 74 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTKLEIK

SEQ ID NO: 75 - DNA, 18 bp, Artificial Sequence
  Synthetic
cagagcattagcagctat

SEQ ID NO: 76 - protein, 6 aa, Artificial Sequence
  Synthetic
QSISSY

SEQ ID NO: 77 - DNA, 9 bp, Artificial Sequence
  Synthetic
gctgcatcc

SEQ ID NO: 78 - protein, 3 aa, Artificial Sequence
  Synthetic
AAS

SEQ ID NO: 79 - DNA, 30 bp, Artificial Sequence; identical to SEQ ID NO: 31
  Synthetic

SEQ ID NO: 80 - protein, 10 aa, Artificial Sequence
  Synthetic
QQSYSTPPIT

SEQ ID NO: 81 - DNA, 360 bp, Artificial Sequence
  Synthetic
caggtgcagctggtggagtctgggggaggcttggtcaagcctggagggtccctgagactctcctgtgcagcctctggattcaccttccgtgactactccatgagctggatccgccaggctccagggaaggggctggagtgggtttcatacgttactttttttaatagtgccatatactacgcagactctgtgaagggccgattcaccatctccagggacaacgccaagaactcactgtatctgcaaatgaacagcctgagagccgaggacacggccgtatattactgtgcgagagaaagagagcctattgtggggggctttgactactggggccagggaaccctggtcaccgtctcctca

SEQ ID NO: 82 - protein, 120 aa, Artificial Sequence
  Synthetic
QVQLVESGGGLVKPGGSLRLSCAASGFTFRDYSMSWIRQAPGKGLEWVSYVTFFNSAIYYADSVKGRFTISRDNAKNSLYLQMNSLRAEDTAVYYCAREREPIVGGFDYWGQGTLVTVSS

SEQ ID NO: 83 - DNA, 24 bp, Artificial Sequence
  Synthetic
ggattcaccttccgtgactactcc

SEQ ID NO: 84 - protein, 8 aa, Artificial Sequence
  Synthetic
GFTFRDYS

SEQ ID NO: 85 - DNA, 24 bp, Artificial Sequence
  Synthetic
gttactttttttaatagtgccata

SEQ ID NO: 86 - protein, 8 aa, Artificial Sequence
  Synthetic
VTFFNSAI

SEQ ID NO: 87 - DNA, 39 bp, Artificial Sequence
  Synthetic
gcgagagaaagagagcctattgtggggggctttgactac

SEQ ID NO: 88 - protein, 13 aa, Artificial Sequence
  Synthetic
AREREPIVGGFDY

SEQ ID NO: 89 - DNA, 324 bp, Artificial Sequence
  Synthetic
gacatccagatgacccagtctccatcctccctgtctgcatctgttggagacagagtcaccatcacttgccgggcaagtcagagcattaacagctatttaaattggtatcagcagaaaccagggaaagcccctaagctcctgatctatgctgcatccagtttgcaaggtggggtcccatcaaggttcagtggcggtggatctgggacagatttcactctcaccatcaccagtctgcaacctgaagattttgcaactttctactgtcaacagagttacagttctcctccgatcaccttcggccaagggacacgactggagattaaa

SEQ ID NO: 90 - protein, 108 aa, Artificial Sequence
  Synthetic
DIQMTQSPSSLSASVGDRVTITCRASQSINSYLNWYQQKPGKAPKLLIYAASSLQGGVPSRFSGGGSGTDFTLTITSLQPEDFATFYCQQSYSSPPITFGQGTRLEIK

SEQ ID NO: 91 - DNA, 18 bp, Artificial Sequence
  Synthetic
cagagcattaacagctat

SEQ ID NO: 92 - protein, 6 aa, Artificial Sequence
  Synthetic
QSINSY

SEQ ID NO: 93 - DNA, 9 bp, Artificial Sequence
  Synthetic
gctgcatcc

SEQ ID NO: 94 - protein, 3 aa, Artificial Sequence
  Synthetic
AAS

SEQ ID NO: 95 - DNA, 30 bp, Artificial Sequence
  Synthetic
caacagagttacagttctcctccgatcacc

SEQ ID NO: 96 - protein, 10 aa, Artificial Sequence
  Synthetic
QQSYSSPPIT

SEQ ID NO: 97 - DNA, 387 bp, Artificial Sequence
  Synthetic
gaggtgcagctggtggagtctgggggaggcttggaacagccagggcggtccctgagactctcctgtacagcttctggattcgcctttggtgatcatactatgagctgggtccgccaggctccagggaaggggctggagtgggtaggtttcattagaagtagagcttatggtgggacaacagaatacgccgcgtctgtgaaaggcagattcaccatctcaagagatgattccaaaagcatcgcctatctgcaaatggacagcctgaaaaccgaggacacagccgtgtattattgtactagcgggggatatgatagtagtcttcattactactattactaccacggtatggacgtctggggccgagggaccacggtcaccgtctcctca

SEQ ID NO: 98 - protein, 129 aa, Artificial Sequence
  Synthetic
EVQLVESGGGLEQPGRSLRLSCTASGFAFGDHTMSWVRQAPGKGLEWVGFIRSRAYGGTTEYAASVKGRFTISRDDSKSIAYLQMDSLKTEDTAVYYCTSGGYDSSLHYYYYYHGMDVWGRGTTVTVSS

SEQ ID NO: 99 - DNA, 24 bp, Artificial Sequence
  Synthetic
ggattcgcctttggtgatcatact

SEQ ID NO: 100 - protein, 8 aa, Artificial Sequence
  Synthetic
GFAFGDHT

SEQ ID NO: 101 - DNA, 30 bp, Artificial Sequence
  Synthetic
attagaagtagagcttatggtgggacaaca

SEQ ID NO: 102 - protein, 10 aa, Artificial Sequence
  Synthetic
IRSRAYGGTT

SEQ ID NO: 103 - DNA, 60 bp, Artificial Sequence
  Synthetic
actagcgggggatatgatagtagtcttcattactactattactaccacggtatggacgtc

SEQ ID NO: 104 - protein, 20 aa, Artificial Sequence
  Synthetic
TSGGYDSSLHYYYYYHGMDV

SEQ ID NO: 105 - DNA, 324 bp, Artificial Sequence
  Synthetic
gaaattgtgttgacgcagtctccaggcaccctgtctttgtctccaggggagagagccaccctctcctgcagggccagtcagagtattaccagcagctacttagcctggtaccagcagagacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagttcaccttggacgttcggccaagggaccaaggtggaaatcaaa

SEQ ID NO: 106 - protein, 108 aa, Artificial Sequence
  Synthetic
EIVLTQSPGTLSLSPGERATLSCRASQSITSSYLAWYQQRPGQAPRLLIYGASSRATGIPDRFSGSGSGTDFTLTISRLEPEDFAVYYCQQYGSSPWTFGQGTKVEIK

SEQ ID NO: 107 - DNA, 21 bp, Artificial Sequence
  Synthetic
cagagtattaccagcagctac

SEQ ID NO: 108 - protein, 7 aa, Artificial Sequence
  Synthetic
QSITSSY

SEQ ID NO: 109 - DNA, 9 bp, Artificial Sequence
  Synthetic
ggtgcatcc

SEQ ID NO: 110 - protein, 3 aa, Artificial Sequence
  Synthetic
GAS

SEQ ID NO: 111 - DNA, 27 bp, Artificial Sequence
  Synthetic
cagcagtatggtagttcaccttggacg

SEQ ID NO: 112 - protein, 9 aa, Artificial Sequence
  Synthetic
QQYGSSPWT

SEQ ID NO: 113 - DNA, 387 bp, Artificial Sequence
  Synthetic
gaggtgcagctggtggagtctgggggaggcttggtacagccagggcggtccctgagactctcctgtacaggttctggactcacctttggtgattatggtatgagctgggtccgccaggctccaggaaaggggctggagtgggtaggtttcattagaagtaaaggttatggtgggacaacagaatacgccgcgtctgtgaaaggcagattcaccatctcaagagatgattccaaaagcaccgcctatctgcaaatgaacagcctgaaaaccgaggacacagccgtgtattattgtactagtgggggatatgatagtagtgttcattactactactactattacgctatggacgtctggggccaagggaccacggtcaccgtctcctca

SEQ ID NO: 114 - protein, 129 aa, Artificial Sequence
  Synthetic
EVQLVESGGGLVQPGRSLRLSCTGSGLTFGDYGMSWVRQAPGKGLEWVGFIRSKGYGGTTEYAASVKGRFTISRDDSKSTAYLQMNSLKTEDTAVYYCTSGGYDSSVHYYYYYYAMDVWGQGTTVTVSS

SEQ ID NO: 115 - DNA, 24 bp, Artificial Sequence
  Synthetic
ggactcacctttggtgattatggt

SEQ ID NO: 116 - protein, 8 aa, Artificial Sequence
  Synthetic
GLTFGDYG

SEQ ID NO: 117 - DNA, 30 bp, Artificial Sequence
  Synthetic
attagaagtaaaggttatggtgggacaaca

SEQ ID NO: 118 - protein, 10 aa, Artificial Sequence
  Synthetic
IRSKGYGGTT

SEQ ID NO: 119 - DNA, 60 bp, Artificial Sequence
  Synthetic
actagtgggggatatgatagtagtgttcattactactactactattacgctatggacgtc

SEQ ID NO: 120 - protein, 20 aa, Artificial Sequence
  Synthetic
TSGGYDSSVHYYYYYYAMDV

SEQ ID NO: 121 - DNA, 324 bp, Artificial Sequence
  Synthetic
gaaattgtgttgacgcagtctccaggcaccctgtctttgtctccaggggaaagagccaccctctcctgcagggccagtcagactgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccttggacgttcggccaagggaccaaggtggaaatcaaa

SEQ ID NO: 122 - protein, 108 aa, Artificial Sequence
  Synthetic
EIVLTQSPGTLSLSPGERATLSCRASQTVSSSYLAWYQQKPGQAPRLLIYGASSRATGIPDRFSGSGSGTDFTLTISRLEPEDFAVYYCQQYGSSPWTFGQGTKVEIK

SEQ ID NO: 123 - DNA, 21 bp, Artificial Sequence
  Synthetic
cagactgttagcagcagctac

SEQ ID NO: 124 - protein, 7 aa, Artificial Sequence
  Synthetic
QTVSSSY

SEQ ID NO: 125 - DNA, 9 bp, Artificial Sequence
  Synthetic
ggtgcatcc

SEQ ID NO: 126 - protein, 3 aa, Artificial Sequence
  Synthetic
GAS

SEQ ID NO: 127 - DNA, 27 bp, Artificial Sequence
  Synthetic
cagcagtatggtagctcaccttggacg

SEQ ID NO: 128 - protein, 9 aa, Artificial Sequence
  Synthetic
QQYGSSPWT

SEQ ID NO: 129 - DNA, 363 bp, Artificial Sequence
  Synthetic
caggtgcagctggtggagtctgggggaggcgtggtccagcctgggaggtccctgagactctcctgtgtagcctctggattcaccttcagtaattatggcatacactgggtccgccaggctccaggcaagggactagagtgggtggcagttatatcagatgatggaagttttaaattctatgcagactccgtgaagggccgattcaccatctccagagacaattccaagaacacgctgtatcttcaaatgaacagcctgagagttgaggactcggctgtttatcactgtgcgaaatggcaacacaactggaacgacgggggatttgactactggggccagggaaccctggtcactgtctcctca

SEQ ID NO: 130 - protein, 121 aa, Artificial Sequence
  Synthetic
QVQLVESGGGVVQPGRSLRLSCVASGFTFSNYGIHWVRQAPGKGLEWVAVISDDGSFKFYADSVKGRFTISRDNSKNTLYLQMNSLRVEDSAVYHCAKWQHNWNDGGFDYWGQGTLVTVSS

SEQ ID NO: 131 - DNA, 24 bp, Artificial Sequence
  Synthetic
ggattcaccttcagtaattatggc

SEQ ID NO: 132 - protein, 8 aa, Artificial Sequence
  Synthetic
GFTFSNYG

SEQ ID NO: 133 - DNA, 24 bp, Artificial Sequence
  Synthetic
atatcagatgatggaagttttaaa

SEQ ID NO: 134 - protein, 8 aa, Artificial Sequence
  Synthetic
ISDDGSFK

SEQ ID NO: 135 - DNA, 42 bp, Artificial Sequence
  Synthetic
gcgaaatggcaacacaactggaacgacgggggatttgactac

SEQ ID NO: 136 - protein, 14 aa, Artificial Sequence
  Synthetic
AKWQHNWNDGGFDY

SEQ ID NO: 137 - DNA, 324 bp, Artificial Sequence
  Synthetic
gaaattgtgttgacacagtctccagacaccctgtctttgtctccaggggaaagagccaccctctcctgcagggccagtcagagtcttagcagcaactacttagcctggtaccggcagaaacctggccaggctcccaggctcctcatctatggtatatccagcagggccactggcatcccagacaggttcagtggcagtgggtctgggacagacttcactctcaccatcagcagactggagcctgaagattttgcagtgtattactgtcagcagtatggtagttcaccttggacgttcggccaagggaccaaggtggaaatcaaa

SEQ ID NO: 138 - protein, 108 aa, Artificial Sequence
  Synthetic
EIVLTQSPDTLSLSPGERATLSCRASQSLSSNYLAWYRQKPGQAPRLLIYGISSRATGIPDRFSGSGSGTDFTLTISRLEPEDFAVYYCQQYGSSPWTFGQGTKVEIK

SEQ ID NO: 139 - DNA, 21 bp, Artificial Sequence
  Synthetic
cagagtcttagcagcaactac

SEQ ID NO: 140 - protein, 7 aa, Artificial Sequence
  Synthetic
QSLSSNY

SEQ ID NO: 141 - DNA, 9 bp, Artificial Sequence
  Synthetic
ggtatatcc

SEQ ID NO: 142 - protein, 3 aa, Artificial Sequence
  Synthetic
GIS

SEQ ID NO: 143 - DNA, 27 bp, Artificial Sequence
  Synthetic
cagcagtatggtagttcaccttggacg

SEQ ID NO: 144 - protein, 9 aa, Artificial Sequence
  Synthetic
QQYGSSPWT

SEQ ID NO: 145 - DNA, 339 bp, Artificial Sequence
  Synthetic
gaggtgcagctggtggagtctgggggagccttggtccagccgggggggtccctgagactctcctgtgcagcctctggattcaccttcagtagctatgctatgcactgggtccgccaggctccagggaagggtctggaatttgtttcaactattagttataatgggggtaccacatactatgcagactctgtgaagggcagattcaccgtctccagagacaattccaaaaacacggtgtttcttcgcatgggcagcctgagaactgaagacatggctgtgtattactgtgcgagagcagcagctccctggggccagggcaccctggtcactgtctcctca

SEQ ID NO: 146 - protein, 113 aa, Artificial Sequence
  Synthetic
EVQLVESGGALVQPGGSLRLSCAASGFTFSSYAMHWVRQAPGKGLEFVSTISYNGGTTYYADSVKGRFTVSRDNSKNTVFLRMGSLRTEDMAVYYCARAAAPWGQGTLVTVSS

SEQ ID NO: 147 - DNA, 24 bp, Artificial Sequence
  Synthetic
ggattcaccttcagtagctatgct

SEQ ID NO: 148 - protein, 8 aa, Artificial Sequence
  Synthetic
GFTFSSYA

SEQ ID NO: 149 - DNA, 24 bp, Artificial Sequence
  Synthetic
attagttataatgggggtaccaca

SEQ ID NO: 150 - protein, 8 aa, Artificial Sequence
  Synthetic
ISYNGGTT

SEQ ID NO: 151 - DNA, 18 bp, Artificial Sequence
  Synthetic
gcgagagcagcagctccc

SEQ ID NO: 152 - protein, 6 aa, Artificial Sequence
  Synthetic
ARAAAP

SEQ ID NO: 153 - DNA, 324 bp, Artificial Sequence
  Synthetic
gaaattgtgttgacgcagtctccagacaccctgtctttgtctccaggggaaagagccaccctctcctgcagggccagtcagagtgttagcaacaggtacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcaccagtatggaagctcaccttggacgttcggccaagggaccaaggtggaaatcaaa

SEQ ID NO: 154 - protein, 108 aa, Artificial Sequence
  Synthetic
EIVLTQSPDTLSLSPGERATLSCRASQSVSNRYLAWYQQKPGQAPRLLIYGASSRATGIPDRFSGSGSGTDFTLTISRLEPEDFAVYYCHQYGSSPWTFGQGTKVEIK

SEQ ID NO: 155 - DNA, 21 bp, Artificial Sequence
  Synthetic
cagagtgttagcaacaggtac

SEQ ID NO: 156 - protein, 7 aa, Artificial Sequence
  Synthetic
QSVSNRY

SEQ ID NO: 157 - DNA, 9 bp, Artificial Sequence
  Synthetic
ggtgcatcc

SEQ ID NO: 158 - protein, 3 aa, Artificial Sequence
  Synthetic
GAS

SEQ ID NO: 159 - DNA, 27 bp, Artificial Sequence
  Synthetic
caccagtatggaagctcaccttggacg

SEQ ID NO: 160 - protein, 9 aa, Artificial Sequence
  Synthetic
HQYGSSPWT

SEQ ID NO: 161 - DNA, 360 bp, Artificial Sequence
  Synthetic
caggtgcagctggtgcagtctggggctgaggtgaagaagcctggggcctcagtgaaggtctcctgcaaggcttttggatacactctcaccggctactatatacactgggtgcgacaggcccctggacaagggcttgagtggatgggatggatcaaccctaacaatggtggcacaaactatgcacagaagtttcagggcagggtcaccatgaccagggacaaatccatcagcacagcctacatggagctgagcaggctgagatctgacgacacggccgtttattactgtgcgagatcactggaactgctccctgatggtatggacgtctggggccaagggaccacggtcaccgtctcctca

SEQ ID NO: 162 - protein, 120 aa, Artificial Sequence
  Synthetic
QVQLVQSGAEVKKPGASVKVSCKAFGYTLTGYYIHWVRQAPGQGLEWMGWINPNNGGTNYAQKFQGRVTMTRDKSISTAYMELSRLRSDDTAVYYCARSLELLPDGMDVWGQGTTVTVSS

SEQ ID NO: 163 - DNA, 24 bp, Artificial Sequence
  Synthetic
ggatacactctcaccggctactat

SEQ ID NO: 164 - protein, 8 aa, Artificial Sequence
  Synthetic
GYTLTGYY

SEQ ID NO: 165 - DNA, 24 bp, Artificial Sequence
  Synthetic
atcaaccctaacaatggtggcaca

SEQ ID NO: 166 - protein, 8 aa, Artificial Sequence
  Synthetic
INPNNGGT

SEQ ID NO: 167 - DNA, 39 bp, Artificial Sequence
  Synthetic
gcgagatcactggaactgctccctgatggtatggacgtc

SEQ ID NO: 168 - protein, 13 aa, Artificial Sequence
  Synthetic
ARSLELLPDGMDV

SEQ ID NO: 169 - DNA, 324 bp, Artificial Sequence
  Synthetic
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccttggacgttcggccaagggaccaaggtggaaatcaaa

SEQ ID NO: 170 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 171 - DNA, 21 bp, Artificial Sequence
  Synthetic
cagagtgttagcagcagctac

SEQ ID NO: 172 - protein, 7 aa, Artificial Sequence
  Synthetic
QSVSSSY

SEQ ID NO: 173 - DNA, 9 bp, Artificial Sequence
  Synthetic
ggtgcatcc

SEQ ID NO: 174 - protein, 3 aa, Artificial Sequence
  Synthetic
GAS

SEQ ID NO: 175 - DNA, 27 bp, Artificial Sequence
  Synthetic
cagcagtatggtagctcaccttggacg

SEQ ID NO: 176 - protein, 9 aa, Artificial Sequence
  Synthetic
QQYGSSPWT

SEQ ID NO: 177 - DNA, 342 bp, Artificial Sequence
  Synthetic
caggtgcaactggtggagtctgggggaggcgtggtccagcctgggaggtccctgaaactctcctgtgcagcctctggattcaccttcagtagctattccttacactgggtccgccaggctccaggcaaggggctggagtgggtggcacttatttcatatgatggaagtaatacatactatgcagactccgtgaagggccgattcaccatctccagagacaactccaataacactctgtttcttcaaatgaccagcctgagagctgaggacacggctatatattactgtgcccggtctatagcaacgtcctggggccagggagtcctggtcaccgtctcctca

SEQ ID NO: 178 - protein, 114 aa, Artificial Sequence
  Synthetic
QVQLVESGGGVVQPGRSLKLSCAASGFTFSSYSLHWVRQAPGKGLEWVALISYDGSNTYYADSVKGRFTISRDNSNNTLFLQMTSLRAEDTAIYYCARSIATSWGQGVLVTVSS

SEQ ID NO: 179 - DNA, 24 bp, Artificial Sequence
  Synthetic
ggattcaccttcagtagctattcc

SEQ ID NO: 180 - protein, 8 aa, Artificial Sequence
  Synthetic
GFTFSSYS

SEQ ID NO: 181 - DNA, 24 bp, Artificial Sequence
  Synthetic
atttcatatgatggaagtaataca

SEQ ID NO: 182 - protein, 8 aa, Artificial Sequence
  Synthetic
ISYDGSNT

SEQ ID NO: 183 - DNA, 21 bp, Artificial Sequence
  Synthetic
gcccggtctatagcaacgtcc

SEQ ID NO: 184 - protein, 7 aa, Artificial Sequence
  Synthetic
ARSIATS

SEQ ID NO: 185 - DNA, 324 bp, Artificial Sequence
  Synthetic
gaaattgtgttgacgcagtctccaggcaccctgtctttgtctccaggggaaagagccaccctctcctgcagggccagtcagagcgttagcaacaggtacttagcctggcaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccttgggcgttcggccaagggaccaaggtggaaatcaaa

SEQ ID NO: 186 - protein, 108 aa, Artificial Sequence
  Synthetic
EIVLTQSPGTLSLSPGERATLSCRASQSVSNRYLAWHQQKPGQAPRLLIYGASSRATGIPDRFSGSGSGTDFTLTISRLEPEDFAVYYCQQYGSSPWAFGQGTKVEIK

SEQ ID NO: 187 - DNA, 21 bp, Artificial Sequence
  Synthetic
cagagcgttagcaacaggtac

SEQ ID NO: 188 - protein, 7 aa, Artificial Sequence
  Synthetic
QSVSNRY

SEQ ID NO: 189 - DNA, 9 bp, Artificial Sequence
  Synthetic
ggtgcatcc

SEQ ID NO: 190 - protein, 3 aa, Artificial Sequence
  Synthetic
GAS

SEQ ID NO: 191 - DNA, 27 bp, Artificial Sequence
  Synthetic
cagcagtatggtagctcaccttgggcg

SEQ ID NO: 192 - protein, 9 aa, Artificial Sequence
  Synthetic
QQYGSSPWA

SEQ ID NO: 193 - DNA, 357 bp, Artificial Sequence
  Synthetic
caggtgcagttgcaggagtcgggcccaggactggtgaagccttcggagaccctgtccctcacctgcactgtctctggtggagccatcaatacttactactggagctggatccggcagcccccagggaagggactggagtggattgggtatatctattacagagggaacaccaactacaacccctccctcaggagtcgagtcaccatatcagtagacacgtccaagaaccagttcttcctgaagctgaggtctgtgaccgttgcggactcggccgtgtatttctgtgcgagaggctggaactaccgcgctgagtacttccagcactggggccagggcaccgtggtcaccgtctcctca

SEQ ID NO: 194 - protein, 119 aa, Artificial Sequence
  Synthetic
QVQLQESGPGLVKPSETLSLTCTVSGGAINTYYWSWIRQPPGKGLEWIGYIYYRGNTNYNPSLRSRVTISVDTSKNQFFLKLRSVTVADSAVYFCARGWNYRAEYFQHWGQGTVVTVSS

SEQ ID NO: 195 - DNA, 24 bp, Artificial Sequence
  Synthetic
ggtggagccatcaatacttactac

SEQ ID NO: 196 - protein, 8 aa, Artificial Sequence
  Synthetic
GGAINTYY

SEQ ID NO: 197 - DNA, 21 bp, Artificial Sequence
  Synthetic
atctattacagagggaacacc

SEQ ID NO: 198 - protein, 7 aa, Artificial Sequence
  Synthetic
IYYRGNT

SEQ ID NO: 199 - DNA, 39 bp, Artificial Sequence
  Synthetic
gcgagaggctggaactaccgcgctgagtacttccagcac

SEQ ID NO: 200 - protein, 13 aa, Artificial Sequence
  Synthetic
ARGWNYRAEYFQH

SEQ ID NO: 201 - DNA, 354 bp, Artificial Sequence
  Synthetic
caggtgcagctgcaggagtcgggcccaggactggtgaagccttcggagaccctgtccctcacctgcactgtctctggtggctccatcagtagtcactactggagctggatccggcagcccccagggaagggactggaatggattggttatatctattacagtgggagcaccaactacaacccctccctcaagagtcgagtcaccatttcagtagacaggtccaagaaccggttctccctgaagctgagctctgtgaccgctgcggacacggccgtgtattactgtgcgaggaccttctacgatgactacgcatttgactactggggccagggaaccctggtcaccgtctcctca

SEQ ID NO: 202 - protein, 118 aa, Artificial Sequence
  Synthetic
QVQLQESGPGLVKPSETLSLTCTVSGGSISSHYWSWIRQPPGKGLEWIGYIYYSGSTNYNPSLKSRVTISVDRSKNRFSLKLSSVTAADTAVYYCARTFYDDYAFDYWGQGTLVTVSS

SEQ ID NO: 203 - DNA, 24 bp, Artificial Sequence
  Synthetic
ggtggctccatcagtagtcactac

SEQ ID NO: 204 - protein, 8 aa, Artificial Sequence
  Synthetic
GGSISSHY

SEQ ID NO: 205 - DNA, 21 bp, Artificial Sequence
  Synthetic
atctattacagtgggagcacc

SEQ ID NO: 206 - protein, 7 aa, Artificial Sequence
  Synthetic
IYYSGST

SEQ ID NO: 207 - DNA, 36 bp, Artificial Sequence
  Synthetic
gcgaggaccttctacgatgactacgcatttgactac

SEQ ID NO: 208 - protein, 12 aa, Artificial Sequence
  Synthetic
ARTFYDDYAFDY

SEQ ID NO: 209 - DNA, 324 bp, Artificial Sequence
  Synthetic
gaaattgtgttgacgcagtctccaggcaccctgtctttgtctccaggggaaagagccaccctctcctgcagggccagtcagagtgttgacaccacctacttagcctggtaccagcagaaacctggccaggctcccaggctcctcatctttgatgcatccagcagggccactggcatcccagacaggttcagtggcagtgggtctgggacagacttcactctcaccatcagcagactggagcctgaagattttgcagtgtattactgtcagcaatatggtagctcaccgttcactttcggcggagggaccaaggtggagatcaaa

SEQ ID NO: 210 - protein, 108 aa, Artificial Sequence
  Synthetic
EIVLTQSPGTLSLSPGERATLSCRASQSVDTTYLAWYQQKPGQAPRLLIFDASSRATGIPDRFSGSGSGTDFTLTISRLEPEDFAVYYCQQYGSSPFTFGGGTKVEIK

SEQ ID NO: 211 - DNA, 21 bp, Artificial Sequence
  Synthetic
cagagtgttgacaccacctac

SEQ ID NO: 212 - protein, 7 aa, Artificial Sequence
  Synthetic
QSVDTTY

SEQ ID NO: 213 - DNA, 9 bp, Artificial Sequence
  Synthetic
gatgcatcc

SEQ ID NO: 214 - protein, 3 aa, Artificial Sequence
  Synthetic
DAS

SEQ ID NO: 215 - DNA, 27 bp, Artificial Sequence
  Synthetic
cagcaatatggtagctcaccgttcact

SEQ ID NO: 216 - protein, 9 aa, Artificial Sequence
  Synthetic
QQYGSSPFT

SEQ ID NO: 217 - DNA, 354 bp, Artificial Sequence
  Synthetic
caggtgcagctgcaggagtcgggcccaggactggtgaagccttcggagaccctgtccctcacctgcactgtctctggtggctccatcagtagttactactggagctggatccggcagcccccagggaagggactggagtggattgggtatgtcgattacagtgggagcaccgactacaacccctccctcaagagtcgagtcaccatatcagtagacacgtccaagaaccagttttccctgaggctgaactctgtgaccgctgcggacacggccgtgtattactgtgcgagaggatttaactggaactacgagtttgactactggggccagggaaccctggtcaccgtctcctca

SEQ ID NO: 218 - protein, 118 aa, Artificial Sequence
  Synthetic
QVQLQESGPGLVKPSETLSLTCTVSGGSISSYYWSWIRQPPGKGLEWIGYVDYSGSTDYNPSLKSRVTISVDTSKNQFSLRLNSVTAADTAVYYCARGFNWNYEFDYWGQGTLVTVSS

SEQ ID NO: 219 - DNA, 24 bp, Artificial Sequence
  Synthetic
ggtggctccatcagtagttactac

SEQ ID NO: 220 - protein, 8 aa, Artificial Sequence
  Synthetic
GGSISSYY

SEQ ID NO: 221 - DNA, 21 bp, Artificial Sequence
  Synthetic
gtcgattacagtgggagcacc

SEQ ID NO: 222 - protein, 7 aa, Artificial Sequence
  Synthetic
VDYSGST

SEQ ID NO: 223 - DNA, 36 bp, Artificial Sequence
  Synthetic
gcgagaggatttaactggaactacgagtttgactac

SEQ ID NO: 224 - protein, 12 aa, Artificial Sequence
  Synthetic
ARGFNWNYEFDY

SEQ ID NO: 225 - DNA, 324 bp, Artificial Sequence
  Synthetic
gaaattgtgttgacgcagtctccaggcaccctgtctttgtctccaggggaaagagccaccctctcctgcagggccagtcagagtgttagtagtacctacttagcctggtaccaacagaaacctggccaggctcccagactcctcatctatggtgcatccagcagggccactggcatcccagacaggttcagtggcagtgggtctgggacagacttcactctcaccatcagcagactggagcctgaagattttgcagtttattactgtcagcagtatggtagctcaccgtacacttttggccaggggaccacgctggagatcaaa

SEQ ID NO: 226 - protein, 108 aa, Artificial Sequence
  Synthetic
EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPYTFGQGTTLEIK

SEQ ID NO: 227 - DNA, 21 bp, Artificial Sequence
  Synthetic
cagagtgttagtagtacctac

SEQ ID NO: 228 - protein, 7 aa, Artificial Sequence
  Synthetic
QSVSSTY

SEQ ID NO: 229 - DNA, 9 bp, Artificial Sequence
  Synthetic
ggtgcatcc

SEQ ID NO: 230 - protein, 3 aa, Artificial Sequence
  Synthetic
GAS

SEQ ID NO: 231 - DNA, 27 bp, Artificial Sequence
  Synthetic
cagcagtatggtagctcaccgtacact

SEQ ID NO: 232 - protein, 9 aa, Artificial Sequence
  Synthetic
QQYGSSPYT

SEQ ID NO: 233 - DNA, 351 bp, Artificial Sequence
  Synthetic
cagatgcagttgcaggagtcgggcccaggactggtgaagccttcggagaccctgtccctcacctgcactgtctctggtggctccatcagtagttactactggaactggatccggcagcccccagggaagggactggaatggattggctatatctattacagtgggaacaacttcaacccctccctcaagagtcgagtcaccatatcagttgacacgtccaagaaccagttctccctgaagctgagctctgtgaccgctgcggacacggccgtgtattactgtgcgagagcgtttcactggaactacgaatttgactactggggccagggaaccctggtcaccgtctcctca

SEQ ID NO: 234 - protein, 117 aa, Artificial Sequence
  Synthetic
QMQLQESGPGLVKPSETLSLTCTVSGGSISSYYWNWIRQPPGKGLEWIGYIYYSGNNFNPSLKSRVTISVDTSKNQFSLKLSSVTAADTAVYYCARAFHWNYEFDYWGQGTLVTVSS

SEQ ID NO: 235 - DNA, 24 bp, Artificial Sequence
  Synthetic
ggtggctccatcagtagttactac

SEQ ID NO: 236 - protein, 8 aa, Artificial Sequence
  Synthetic
GGSISSYY

SEQ ID NO: 237 - DNA, 18 bp, Artificial Sequence
  Synthetic
atctattacagtgggaac

SEQ ID NO: 238 - protein, 6 aa, Artificial Sequence
  Synthetic
IYYSGN

SEQ ID NO: 239 - DNA, 36 bp, Artificial Sequence
  Synthetic
gcgagagcgtttcactggaactacgaatttgactac

SEQ ID NO: 240 - protein, 12 aa, Artificial Sequence
  Synthetic
ARAFHWNYEFDY

SEQ ID NO: 241 - DNA, 324 bp, Artificial Sequence
  Synthetic
gaaattgtgttgacgcagtctccaggcaccctgtctttgtctccaggggagagagccaccctctcctgcagggccagtcagagtgttagcaacaactacttagcctggtaccagcagaaacctggccaggctcccaggctcctcctctatggtgcatccagcaggaccactgacatcccagacaggttcagtggcagtgggtctgggacagacttcactctcaccatcagcagactggagcctgaagattttgcagtatattactgtcagcagtatgataactcaccgctcactttcggcggagggaccaaggtggagatcaga

SEQ ID NO: 242 - protein, 108 aa, Artificial Sequence
  Synthetic
EIVLTQSPGTLSLSPGERATLSCRASQSVSNNYLAWYQQKPGQAPRLLLYGASSRTTDIPDRFSGSGSGTDFTLTISRLEPEDFAVYYCQQYDNSPLTFGGGTKVEIR

SEQ ID NO: 243 - DNA, 21 bp, Artificial Sequence
  Synthetic
cagagtgttagcaacaactac

SEQ ID NO: 244 - protein, 7 aa, Artificial Sequence
  Synthetic
QSVSNNY

SEQ ID NO: 245 - DNA, 9 bp, Artificial Sequence
  Synthetic
ggtgcatcc

SEQ ID NO: 246 - protein, 3 aa, Artificial Sequence
  Synthetic
GAS

SEQ ID NO: 247 - DNA, 27 bp, Artificial Sequence
  Synthetic
cagcagtatgataactcaccgctcact

SEQ ID NO: 248 - protein, 9 aa, Artificial Sequence
  Synthetic
QQYDNSPLT

SEQ ID NO: 249 - DNA, 366 bp, Artificial Sequence
  Synthetic
gaagtgcaactggtggagtctgggggaggcttggtacagcctggcaggtccctgagactctcctgtgcagcctctggattcacctttgatgaatatgccatgcactgggtccggcaagctccagggaagggcctggagtgggtctcaagtattagttggaatcagggcaatatagactatgcggactctgtgaagggccgattcaccatctccagagacaacgccaagggctccctgtatctacaaatgaacagtctgagagctgaggacacggccttatattattgtgtaaaagatcggagttcccactactactactacggtatggacgtctggggccaagggaccacggtcaccgtctcctca

SEQ ID NO: 250 - protein, 122 aa, Artificial Sequence
  Synthetic
EVQLVESGGGLVQPGRSLRLSCAASGFTFDEYAMHWVRQAPGKGLEWVSSISWNQGNIDYADSVKGRFTISRDNAKGSLYLQMNSLRAEDTALYYCVKDRSSHYYYYGMDVWGQGTTVTVSS

SEQ ID NO: 251 - DNA, 24 bp, Artificial Sequence
  Synthetic
ggattcacctttgatgaatatgcc

SEQ ID NO: 252 - protein, 8 aa, Artificial Sequence
  Synthetic
GFTFDEYA

SEQ ID NO: 253 - DNA, 24 bp, Artificial Sequence
  Synthetic
attagttggaatcagggcaatata

SEQ ID NO: 254 - protein, 8 aa, Artificial Sequence
  Synthetic
ISWNQGNI

SEQ ID NO: 255 - DNA, 45 bp, Artificial Sequence
  Synthetic
gtaaaagatcggagttcccactactactactacggtatggacgtc

SEQ ID NO: 256 - protein, 15 aa, Artificial Sequence
  Synthetic
VKDRSSHYYYYGMDV

SEQ ID NO: 257 - DNA, 357 bp, Artificial Sequence
  Synthetic
cagatgcagctacaacagtggggcgcaggactgttgaagccttcggagaccctgtccctcacctgcgctgtctatggtgggtccctcagtggttactactggaactggatccgccagtccccagggaaggggctggagtggattgggaaaatcaatcatagtggaagcaccaactacaacccgtccctcaagagtcgagtcaccatatcagtagacaggtccaggatccagttctccctgaagctgagttctgtgaccgccgcggacacggctgtgtattactgtgcgagagcgctggaactactcacggacggtatggacgtctggggccaagggaccacggtcaccgtctcctca

SEQ ID NO: 258 - protein, 119 aa, Artificial Sequence
  Synthetic
QMQLQQWGAGLLKPSETLSLTCAVYGGSLSGYYWNWIRQSPGKGLEWIGKINHSGSTNYNPSLKSRVTISVDRSRIQFSLKLSSVTAADTAVYYCARALELLTDGMDVWGQGTTVTVSS

SEQ ID NO: 259 - DNA, 24 bp, Artificial Sequence
  Synthetic
ggtgggtccctcagtggttactac

SEQ ID NO: 260 - protein, 8 aa, Artificial Sequence
  Synthetic
GGSLSGYY

SEQ ID NO: 261 - DNA, 21 bp, Artificial Sequence
  Synthetic
atcaatcatagtggaagcacc

SEQ ID NO: 262 - protein, 7 aa, Artificial Sequence
  Synthetic
INHSGST

SEQ ID NO: 263 - DNA, 39 bp, Artificial Sequence
  Synthetic
gcgagagcgctggaactactcacggacggtatggacgtc

SEQ ID NO: 264 - protein, 13 aa, Artificial Sequence
  Synthetic
ARALELLTDGMDV

SEQ ID NO: 265 - DNA, 324 bp, Artificial Sequence
  Synthetic
gaaattgtgttgacgcagtctccaggcaccctgtctttgtctccaggggaaagagccaccctctcctgcagggccagtcagagtgttagcagcaactacttagcctggtaccagcagacacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccttggacgttcggccaagggaccaaggtggaaatcaaa

SEQ ID NO: 266 - protein, 108 aa, Artificial Sequence
  Synthetic
EIVLTQSPGTLSLSPGERATLSCRASQSVSSNYLAWYQQTPGQAPRLLIYGASSRATGIPDRFSGSGSGTDFTLTISRLEPEDFAVYYCQQYGSSPWTFGQGTKVEIK

SEQ ID NO: 267 - DNA, 21 bp, Artificial Sequence
  Synthetic
cagagtgttagcagcaactac

SEQ ID NO: 268 - protein, 7 aa, Artificial Sequence
  Synthetic
QSVSSNY

SEQ ID NO: 269 - DNA, 9 bp, Artificial Sequence
  Synthetic
ggtgcatcc

SEQ ID NO: 270 - protein, 3 aa, Artificial Sequence
  Synthetic
GAS

SEQ ID NO: 271 - DNA, 27 bp, Artificial Sequence
  Synthetic
cagcagtatggtagctcaccttggacg

SEQ ID NO: 272 - protein, 9 aa, Artificial Sequence
  Synthetic
QQYGSSPWT

SEQ ID NO: 273 - DNA, 366 bp, Artificial Sequence
  Synthetic
gaagtgcagttggtggagtctgggggaggcttggtacagcctggcaggtccctgagactctcctgtgcagcctctggattcacctttgatgattatgccatgcactgggtccggcaagctccagggaggggcctggagtgggtctcaagtattagttggaatagtgataacatagactatgcggactctgtgaagggccggttcaccatcgccagagacagcgccaagaactccctgtatctgcaaatgaacagtctgagagctgaggacacggccttatattactgtgtgaaagatcgcagctcccactactactactacggtatggacgtctggggccaagggaccacggtcaccgtctcctca

SEQ ID NO: 274 - protein, 122 aa, Artificial Sequence
  Synthetic
EVQLVESGGGLVQPGRSLRLSCAASGFTFDDYAMHWVRQAPGRGLEWVSSISWNSDNIDYADSVKGRFTIARDSAKNSLYLQMNSLRAEDTALYYCVKDRSSHYYYYGMDVWGQGTTVTVSS

SEQ ID NO: 275 - DNA, 24 bp, Artificial Sequence
  Synthetic
ggattcacctttgatgattatgcc

SEQ ID NO: 276 - protein, 8 aa, Artificial Sequence
  Synthetic
GFTFDDYA

SEQ ID NO: 277 - DNA, 24 bp, Artificial Sequence
  Synthetic
attagttggaatagtgataacata

SEQ ID NO: 278 - protein, 8 aa, Artificial Sequence
  Synthetic
ISWNSDNI

SEQ ID NO: 279 - DNA, 45 bp, Artificial Sequence
  Synthetic
gtgaaagatcgcagctcccactactactactacggtatggacgtc

SEQ ID NO: 280 - protein, 15 aa, Artificial Sequence
  Synthetic
VKDRSSHYYYYGMDV

SEQ ID NO: 281 - DNA, 357 bp, Artificial Sequence; identical to SEQ ID NO: 257
  Synthetic

SEQ ID NO: 282 - protein, 119 aa, Artificial Sequence; identical to SEQ ID NO: 258
  Synthetic

SEQ ID NO: 283 - DNA, 24 bp, Artificial Sequence
  Synthetic
ggtgggtccctcagtggttactac

SEQ ID NO: 284 - protein, 8 aa, Artificial Sequence
  Synthetic
GGSLSGYY

SEQ ID NO: 285 - DNA, 21 bp, Artificial Sequence
  Synthetic
atcaatcatagtggaagcacc

SEQ ID NO: 286 - protein, 7 aa, Artificial Sequence
  Synthetic
INHSGST

SEQ ID NO: 287 - DNA, 39 bp, Artificial Sequence; identical to SEQ ID NO: 263
  Synthetic

SEQ ID NO: 288 - protein, 13 aa, Artificial Sequence
  Synthetic
ARALELLTDGMDV

SEQ ID NO: 289 - DNA, 324 bp, Artificial Sequence; identical to SEQ ID NO: 265
  Synthetic

SEQ ID NO: 290 - protein, 108 aa, Artificial Sequence; identical to SEQ ID NO: 266
  Synthetic

SEQ ID NO: 291 - DNA, 21 bp, Artificial Sequence
  Synthetic
cagagtgttagcagcaactac

SEQ ID NO: 292 - protein, 7 aa, Artificial Sequence
  Synthetic
QSVSSNY

SEQ ID NO: 293 - DNA, 9 bp, Artificial Sequence
  Synthetic
ggtgcatcc

SEQ ID NO: 294 - protein, 3 aa, Artificial Sequence
  Synthetic
GAS

SEQ ID NO: 295 - DNA, 27 bp, Artificial Sequence
  Synthetic
cagcagtatggtagctcaccttggacg

SEQ ID NO: 296 - protein, 9 aa, Artificial Sequence
  Synthetic
QQYGSSPWT

SEQ ID NO: 297 - DNA, 363 bp, Artificial Sequence
  Synthetic
gaggtgcagctggtggagtctgggggaggcttggtacaggctggagggtccctgagactctcctgtgcagcctctggattcaccttcagttatcatgaaatgaactgggtccgccaggctccagggaagggactggagtgggtttcatacattggtagtagaggcactaccaaacattatgcagaccctgtgaagggccgattcaccatctccagggacaacgccaagaactcactgtatctgcaaatgaatagcctgagagccgaggacacggctgtttattactgtgcgagtgaagtgggatctattttgggttactctatggacgtctggggccaagggaccacggtcaccgtctcctca

SEQ ID NO: 298 - protein, 121 aa, Artificial Sequence
  Synthetic
EVQLVESGGGLVQAGGSLRLSCAASGFTFSYHEMNWVRQAPGKGLEWVSYIGSRGTTKHYADPVKGRFTISRDNAKNSLYLQMNSLRAEDTAVYYCASEVGSILGYSMDVWGQGTTVTVSS

SEQ ID NO: 299 - DNA, 24 bp, Artificial Sequence
  Synthetic
ggattcaccttcagttatcatgaa

SEQ ID NO: 300 - protein, 8 aa, Artificial Sequence
  Synthetic
GFTFSYHE

SEQ ID NO: 301 - DNA, 24 bp, Artificial Sequence
  Synthetic
attggtagtagaggcactaccaaa

SEQ ID NO: 302 - protein, 8 aa, Artificial Sequence
  Synthetic
IGSRGTTK

SEQ ID NO: 303 - DNA, 42 bp, Artificial Sequence
  Synthetic
gcgagtgaagtgggatctattttgggttactctatggacgtc

SEQ ID NO: 304 - protein, 14 aa, Artificial Sequence
  Synthetic
ASEVGSILGYSMDV

SEQ ID NO: 305 - DNA, 324 bp, Artificial Sequence
  Synthetic
gacatccagatgacccagtctccatcctccctgtctgcatctgtaggagacagagtcaccatcacttgccgggcaagtcagagcgttagcaggtatttaaattggtgtcaacagaaaccagggaaagcccctaagctcctgacctatgctgcatccagtttgcaaagtggggtcccatcaaggttcagtggcagtggatctgggacagatttcactctcaccataagcagtctgcaacctgaagattttgcagcttacttctgtcaacagagttacagtacccctccgatcaccttcggccaagggacacgactggagattaaa

SEQ ID NO: 306 - protein, 108 aa, Artificial Sequence
  Synthetic
DIQMTQSPSSLSASVGDRVTITCRASQSVSRYLNWCQQKPGKAPKLLTYAASSLQSGVPSRFSGSGSGTDFTLTISSLQPEDFAAYFCQQSYSTPPITFGQGTRLEIK

SEQ ID NO: 307 - DNA, 18 bp, Artificial Sequence
  Synthetic
cagagcgttagcaggtat

SEQ ID NO: 308 - protein, 6 aa, Artificial Sequence
  Synthetic
QSVSRY

SEQ ID NO: 309 - DNA, 9 bp, Artificial Sequence
  Synthetic
gctgcatcc

SEQ ID NO: 310 - protein, 3 aa, Artificial Sequence
  Synthetic
AAS

SEQ ID NO: 311 - DNA, 30 bp, Artificial Sequence; identical to SEQ ID NO: 31
  Synthetic

SEQ ID NO: 312 - protein, 10 aa, Artificial Sequence
  Synthetic
QQSYSTPPIT

SEQ ID NO: 313 - DNA, 375 bp, Artificial Sequence
  Synthetic
caggtgcagctggtgcagtctggggctgaggtgaagaagcctggggcctcagtgaaggtctcctgcaaggcttctggatacaccttcaccagttctgatatcaactgggtgcgacaggccactggccaggggcttgagtgggtgggatggatgaaccctaactatggttacacaggcagtgcacggaagttccaggacagagtcaccatgaccaggaacacctccttaagcactgcctacctggagctgcacagcctgagatctgaggacacggccgtgtattactgtgcgagagtcacatattgtagtagtgtaaccagctgctttagaccatttacctactggggccagggaaccctggtcaccgtctccgca

SEQ ID NO: 314 - protein, 125 aa, Artificial Sequence
  Synthetic
QVQLVQSGAEVKKPGASVKVSCKASGYTFTSSDINWVRQATGQGLEWVGWMNPNYGYTGSARKFQDRVTMTRNTSLSTAYLELHSLRSEDTAVYYCARVTYCSSVTSCFRPFTYWGQGTLVTVSA

SEQ ID NO: 315 - DNA, 24 bp, Artificial Sequence
  Synthetic
ggatacaccttcaccagttctgat

SEQ ID NO: 316 - protein, 8 aa, Artificial Sequence
  Synthetic
GYTFTSSD

SEQ ID NO: 317 - DNA, 24 bp, Artificial Sequence
  Synthetic
atgaaccctaactatggttacaca

SEQ ID NO: 318 - protein, 8 aa, Artificial Sequence
  Synthetic
MNPNYGYT

SEQ ID NO: 319 - DNA, 54 bp, Artificial Sequence
  Synthetic
gcgagagtcacatattgtagtagtgtaaccagctgctttagaccatttacctac

SEQ ID NO: 320 - protein, 18 aa, Artificial Sequence
  Synthetic
ARVTYCSSVTSCFRPFTY

SEQ ID NO: 321 - DNA, 324 bp, Artificial Sequence
  Synthetic
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 322 - protein, 108 aa, Artificial Sequence
  Synthetic
DIQMTQSPSSLSASVGDRVTITCRASQSISNYLNWYQQKPGKAPKLLIYAASSLQSGVPSRFSGSGSGTDFTLTISSLQPEDFATYYCQQSYSTPPITFGQGTRLEIK

SEQ ID NO: 323 - DNA, 18 bp, Artificial Sequence
  Synthetic
cagagcattagcaactat

SEQ ID NO: 324 - protein, 6 aa, Artificial Sequence
  Synthetic
QSISNY

SEQ ID NO: 325 - DNA, 9 bp, Artificial Sequence
  Synthetic
gctgcatcc

SEQ ID NO: 326 - protein, 3 aa, Artificial Sequence
  Synthetic
AAS

SEQ ID NO: 327 - DNA, 30 bp, Artificial Sequence; identical to SEQ ID NO: 31
  Synthetic

SEQ ID NO: 328 - protein, 10 aa, Artificial Sequence
  Synthetic
QQSYSTPPIT

SEQ ID NO: 329 - DNA, 345 bp, Artificial Sequence
  Synthetic
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaaaaaagctcgtctttgactactggggccagggaaccctggtcaccgtctcctca

SEQ ID NO: 330 - protein, 115 aa, Artificial Sequence
  Synthetic
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARKKLVFDYWGQGTLVTVSS

SEQ ID NO: 331 - DNA, 24 bp, Artificial Sequence
  Synthetic
ggtggctccatcagtagttactac

SEQ ID NO: 332 - protein, 8 aa, Artificial Sequence
  Synthetic
GGSISSYY

SEQ ID NO: 333 - DNA, 21 bp, Artificial Sequence
  Synthetic
atctattacagtgggagcacc

SEQ ID NO: 334 - protein, 7 aa, Artificial Sequence
  Synthetic
IYYSGST

SEQ ID NO: 335 - DNA, 27 bp, Artificial Sequence
  Synthetic
gcgagaaaaaagctcgtctttgactac

SEQ ID NO: 336 - protein, 9 aa, Artificial Sequence
  Synthetic
ARKKLVFDY

SEQ ID NO: 337 - DNA, 324 bp, Artificial Sequence
  Synthetic
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtaactcaccttggacgttcggccaagggaccaaggtggaaatcaaa

SEQ ID NO: 338 - protein, 108 aa, Artificial Sequence
  Synthetic
EIVLTQSPGTLSLSPGERATLSCRASQSVSSSYLAWYQQKPGQAPRLLIYGASSRATGIPDRFSGSGSGTDFTLTISRLEPEDFAVYYCQQYGNSPWTFGQGTKVEIK

SEQ ID NO: 339 - DNA, 21 bp, Artificial Sequence
  Synthetic
cagagtgttagcagcagctac

SEQ ID NO: 340 - protein, 7 aa, Artificial Sequence
  Synthetic
QSVSSSY

SEQ ID NO: 341 - DNA, 9 bp, Artificial Sequence
  Synthetic
ggtgcatcc

SEQ ID NO: 342 - protein, 3 aa, Artificial Sequence
  Synthetic
GAS

SEQ ID NO: 343 - DNA, 27 bp, Artificial Sequence
  Synthetic
cagcagtatggtaactcaccttggacg

SEQ ID NO: 344 - protein, 9 aa, Artificial Sequence
  Synthetic
QQYGNSPWT

SEQ ID NO: 345 - DNA, 354 bp, Artificial Sequence
  Synthetic
caggtgcagctacagcagtggggcgcaggactgttgaagccttcggagaccctgtccctcacctgcgctgtctatggtgggtccttcagtgattactactggagctggatccgccagcccccagggaaggggctggagtggattggggaaatcaatcatagaggaaagaccaactacaacccgtccctcaagagtcgagtctccatatcagtagacccgtccaagaaccagttctccctgaagctgagttctgtgaccgccgcggacacggctgtgtattactgtgcgcgacagggctggaactacgccatctttgactactggggccagggaatcctggtccccgtctcctca

SEQ ID NO: 346 - protein, 118 aa, Artificial Sequence
  Synthetic
QVQLQQWGAGLLKPSETLSLTCAVYGGSFSDYYWSWIRQPPGKGLEWIGEINHRGKTNYNPSLKSRVSISVDPSKNQFSLKLSSVTAADTAVYYCARQGWNYAIFDYWGQGILVPVSS

SEQ ID NO: 347 - DNA, 24 bp, Artificial Sequence
  Synthetic
ggtgggtccttcagtgattactac

SEQ ID NO: 348 - protein, 8 aa, Artificial Sequence
  Synthetic
GGSFSDYY

SEQ ID NO: 349 - DNA, 21 bp, Artificial Sequence
  Synthetic
atcaatcatagaggaaagacc

SEQ ID NO: 350 - protein, 7 aa, Artificial Sequence
  Synthetic
INHRGKT

SEQ ID NO: 351 - DNA, 36 bp, Artificial Sequence
  Synthetic
gcgcgacagggctggaactacgccatctttgactac

SEQ ID NO: 352 - protein, 12 aa, Artificial Sequence
  Synthetic
ARQGWNYAIFDY

SEQ ID NO: 353 - DNA, 339 bp, Artificial Sequence
  Synthetic
gacatcgtgatgacccagtctccagactccctggctgtgtctctgggcgagagggccaccatcaactgcaagtccagccagagtgttttatacaggtccaacaataagaactacttaggttggtaccagcagaaaccaggacagcctcctaagctgctcatttactgggcatcttcccgggaagccggggtccctgaccgattcagtggcagcgggtctgggacagaattcactctcaccatcagcagcctgcaggctgaagatgaggcagtttattactgtcagcaatattatagtagtcctccgacgttcggccaagggaccaaggtggaaatcaaa

SEQ ID NO: 354 - protein, 113 aa, Artificial Sequence
  Synthetic
DIVMTQSPDSLAVSLGERATINCKSSQSVLYRSNNKNYLGWYQQKPGQPPKLLIYWASSREAGVPDRFSGSGSGTEFTLTISSLQAEDEAVYYCQQYYSSPPTFGQGTKVEIK

SEQ ID NO: 355 - DNA, 36 bp, Artificial Sequence
  Synthetic
cagagtgttttatacaggtccaacaataagaactac

SEQ ID NO: 356 - protein, 12 aa, Artificial Sequence
  Synthetic
QSVLYRSNNKNY

SEQ ID NO: 357 - DNA, 9 bp, Artificial Sequence
  Synthetic
tgggcatct

SEQ ID NO: 358 - protein, 3 aa, Artificial Sequence
  Synthetic
WAS

SEQ ID NO: 359 - DNA, 27 bp, Artificial Sequence
  Synthetic
cagcaatattatagtagtcctccgacg

SEQ ID NO: 360 - protein, 9 aa, Artificial Sequence
  Synthetic
QQYYSSPPT

SEQ ID NO: 361 - DNA, 354 bp, Artificial Sequence
  Synthetic
caggtgcagcttcagcagtggggcgcaggactgttgaagccttcggagaccctgtccctcacctgcgctgtctatggtgggtccttcagtggttactactggagctggatccgccagcccccagggaaggggctggagtggattggagaaatcaatcatagtggaaaaaccacttacagcccgtccctcaagagtcgagtcaccatatcagtagacacgtccaagagccagttctccctgaagctgagctctgtgaccgccgcggacacggctgtgtattactgtgcgagacagggcttgaactacgccatctttgactactggggccagggaaccctggtcaccgtctcctca

SEQ ID NO: 362 - protein, 118 aa, Artificial Sequence
  Synthetic
QVQLQQWGAGLLKPSETLSLTCAVYGGSFSGYYWSWIRQPPGKGLEWIGEINHSGKTTYSPSLKSRVTISVDTSKSQFSLKLSSVTAADTAVYYCARQGLNYAIFDYWGQGTLVTVSS

SEQ ID NO: 363 - DNA, 24 bp, Artificial Sequence
  Synthetic
ggtgggtccttcagtggttactac

SEQ ID NO: 364 - protein, 8 aa, Artificial Sequence
  Synthetic
GGSFSGYY

SEQ ID NO: 365 - DNA, 21 bp, Artificial Sequence
  Synthetic
atcaatcatagtggaaaaacc

SEQ ID NO: 366 - protein, 7 aa, Artificial Sequence
  Synthetic
INHSGKT

SEQ ID NO: 367 - DNA, 36 bp, Artificial Sequence
  Synthetic
gcgagacagggcttgaactacgccatctttgactac

SEQ ID NO: 368 - protein, 12 aa, Artificial Sequence
  Synthetic
ARQGLNYAIFDY

SEQ ID NO: 369 - DNA, 339 bp, Artificial Sequence
  Synthetic
tacatcgtgatgacccagtctccagactccctggctgtgtctctgggcgagagggccaccatcaactgcaagtccagccggagtattttatacacctccaacaataagaactacttagcttggtatcagcagagaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattttagtagtcctccgacgttcggccaagggaccaaggtggaaatcaaa

SEQ ID NO: 370 - protein, 113 aa, Artificial Sequence
  Synthetic
YIVMTQSPDSLAVSLGERATINCKSSRSILYTSNNKNYLAWYQQRPGQPPKLLIYWASTRESGVPDRFSGSGSGTDFTLTISSLQAEDVAVYYCQQYFSSPPTFGQGTKVEIK

SEQ ID NO: 371 - DNA, 36 bp, Artificial Sequence
  Synthetic
cggagtattttatacacctccaacaataagaactac

SEQ ID NO: 372 - protein, 12 aa, Artificial Sequence
  Synthetic
RSILYTSNNKNY

SEQ ID NO: 373 - DNA, 9 bp, Artificial Sequence
  Synthetic
tgggcatct

SEQ ID NO: 374 - protein, 3 aa, Artificial Sequence
  Synthetic
WAS

SEQ ID NO: 375 - DNA, 27 bp, Artificial Sequence
  Synthetic
cagcaatattttagtagtcctccgacg

SEQ ID NO: 376 - protein, 9 aa, Artificial Sequence
  Synthetic
QQYFSSPPT

SEQ ID NO: 377 - DNA, 354 bp, Artificial Sequence
  Synthetic
caggtgcagctacagcagtggggcgcaggactgttgaagccttcggagaccctgtccctcacctgcgctgtctatggtgggtctttcagtgggttctactggagctggatccgccagcccccagggaaggggctggagtggattggggaaatcaatcatagtggaagcgccaagtacaacccgtccctcaagaatcgagtcatcatatcaatagacacgtccaagaaccagttctccctgaagctggactctgtgaccgccgcggacacggctgtttataactgtgcgagacagggctggaacttcgccatctttgactactggggccagggaacgttggtcgacgtctcctca

SEQ ID NO: 378 - protein, 118 aa, Artificial Sequence
  Synthetic
QVQLQQWGAGLLKPSETLSLTCAVYGGSFSGFYWSWIRQPPGKGLEWIGEINHSGSAKYNPSLKNRVIISIDTSKNQFSLKLDSVTAADTAVYNCARQGWNFAIFDYWGQGTLVDVSS

SEQ ID NO: 379 - DNA, 24 bp, Artificial Sequence
  Synthetic
ggtgggtctttcagtgggttctac

SEQ ID NO: 380 - protein, 8 aa, Artificial Sequence
  Synthetic
GGSFSGFY

SEQ ID NO: 381 - DNA, 21 bp, Artificial Sequence
  Synthetic
atcaatcatagtggaagcgcc

SEQ ID NO: 382 - protein, 7 aa, Artificial Sequence
  Synthetic
INHSGSA

SEQ ID NO: 383 - DNA, 36 bp, Artificial Sequence
  Synthetic
gcgagacagggctggaacttcgccatctttgactac

SEQ ID NO: 384 - protein, 12 aa, Artificial Sequence
  Synthetic
ARQGWNFAIFDY

SEQ ID NO: 385 - DNA, 339 bp, Artificial Sequence
  Synthetic
gacatcgtgatgacccagtctccagactccctggctgtgtctctgggcgggagggccaccatcaactgcaagtccagccagagtgttttacacagttcctacaataaggaccacttagcttggtaccagcagagaccaggacagcctcctaagctgctcatttactgggcatctacccgggaatccggggtccctgaccgattcagtggcagcgggtctgggacagatttcactctcaccatcagcagcctgcaggctgaagatgtggcggtttattattgtcagcaatataatattcttcctccgacgttcggccaagggaccagggtggaaatcaaa

SEQ ID NO: 386 - protein, 113 aa, Artificial Sequence
  Synthetic
DIVMTQSPDSLAVSLGGRATINCKSSQSVLHSSYNKDHLAWYQQRPGQPPKLLIYWASTRESGVPDRFSGSGSGTDFTLTISSLQAEDVAVYYCQQYNILPPTFGQGTRVEIK

SEQ ID NO: 387 - DNA, 36 bp, Artificial Sequence
  Synthetic
cagagtgttttacacagttcctacaataaggaccac

SEQ ID NO: 388 - protein, 12 aa, Artificial Sequence
  Synthetic
QSVLHSSYNKDH

SEQ ID NO: 389 - DNA, 9 bp, Artificial Sequence
  Synthetic
tgggcatct

SEQ ID NO: 390 - protein, 3 aa, Artificial Sequence
  Synthetic
WAS

SEQ ID NO: 391 - DNA, 27 bp, Artificial Sequence
  Synthetic
cagcaatataatattcttcctccgacg

SEQ ID NO: 392 - protein, 9 aa, Artificial Sequence
  Synthetic
QQYNILPPT

SEQ ID NO: 393 - DNA, 324 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccgtcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 394 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 395 - DNA, 18 bp, Artificial Sequence
  Synthetic
cagagcattagcagctat

SEQ ID NO: 396 - protein, 6 aa, Artificial Sequence
  Synthetic
QSISSY

SEQ ID NO: 397 - DNA, 9 bp, Artificial Sequence
  Synthetic
gctgcatcc

SEQ ID NO: 398 - protein, 3 aa, Artificial Sequence
  Synthetic
AAS

SEQ ID NO: 399 - DNA, 30 bp, Artificial Sequence; identical to SEQ ID NO: 31
  Synthetic

SEQ ID NO: 400 - protein, 10 aa, Artificial Sequence
  Synthetic
QQSYSTPPIT

SEQ ID NO: 401 - DNA, 369 bp, Artificial Sequence
  synthetic
gaagtgcaactggtggagtctgggggaggcttagtacagcctggcgggtccctgagactctcctgtgcagccactggattcacctttgatgattttaccatgcactgggtccggcaagctccagggaagggcctggagtgggtctcaggtatcagttggaatagtggtagcataggctatgtggactctgtgaagggccgattcaccatctccagagacaacgccaagaactccctgtatctgcaaatgaacagtctgagagctgaggacacggccttgtactactgtgcaaaagataatagtggctacggctattattactacggtatggacgtctggggccaagggaccacggtcaccgtctcctca

SEQ ID NO: 402 - protein, 123 aa, Artificial Sequence
  synthetic
EVQLVESGGGLVQPGGSLRLSCAATGFTFDDFTMHWVRQAPGKGLEWVSGISWNSGSIGYVDSVKGRFTISRDNAKNSLYLQMNSLRAEDTALYYCAKDNSGYGYYYYGMDVWGQGTTVTVSS

SEQ ID NO: 403 - DNA, 24 bp, Artificial Sequence
  synthetic
ggattcacctttgatgattttacc

SEQ ID NO: 404 - protein, 8 aa, Artificial Sequence
  synthetic
GFTFDDFT

SEQ ID NO: 405 - DNA, 24 bp, Artificial Sequence
  synthetic
atcagttggaatagtggtagcata

SEQ ID NO: 406 - protein, 8 aa, Artificial Sequence
  synthetic
ISWNSGSI

SEQ ID NO: 407 - DNA, 48 bp, Artificial Sequence
  synthetic
gcaaaagataatagtggctacggctattattactacggtatggacgtc

SEQ ID NO: 408 - protein, 16 aa, Artificial Sequence
  synthetic
AKDNSGYGYYYYGMDV

SEQ ID NO: 409 - DNA, 321 bp, Artificial Sequence
  synthetic
gaaatagtgatgacgcagtctccagccaccctgtctgtgtctccaggggaaagagccaccctctcctgcagggccagtcacagtgttagcaggaactcagcctggtaccagcagaaacctggccaggctcccaggctcctcatctatggtgcatccaccagggccactggtatcccagccaggttcagtggcagtgggtctgggacagaattcactctcaccatcagcagcctgcagtctgaagattttgcaatttattactgtcagcagtataataattggcctctcactttcggcggagggaccaaggtggagatcaaa

SEQ ID NO: 410 - protein, 107 aa, Artificial Sequence
  synthetic
EIVMTQSPATLSVSPGERATLSCRASHSVSRNSAWYQQKPGQAPRLLIYGASTRATGIPARFSGSGSGTEFTLTISSLQSEDFAIYYCQQYNNWPLTFGGGTKVEIK

SEQ ID NO: 411 - DNA, 18 bp, Artificial Sequence
  synthetic
cacagtgttagcaggaac

SEQ ID NO: 412 - protein, 6 aa, Artificial Sequence
  synthetic
HSVSRN

SEQ ID NO: 413 - DNA, 9 bp, Artificial Sequence
  synthetic
ggtgcatcc

SEQ ID NO: 414 - protein, 3 aa, Artificial Sequence
  synthetic
GAS

SEQ ID NO: 415 - DNA, 27 bp, Artificial Sequence
  synthetic
cagcagtataataattggcctctcact

SEQ ID NO: 416 - protein, 9 aa, Artificial Sequence
  synthetic
QQYNNWPLT

SEQ ID NO: 417 - DNA, 372 bp, Artificial Sequence
  synthetic
gaagtgcaactggtggaatcggggggaggcttggtacagcctggcgggtccctgagactctcctgtgcagcctctggattctcctttgatgattataccatgcactgggtccggcaacctccagggaagggcctggagtgggtctcaggtattagttggaatagtggtagcataggctatgcggactctgtgaagggccgattcaccatctccagagacaacgccaagaactccctgtatctgcaaatgaacagtctgagagctggggacacggccttgtactactgtgcaaaagataatagtggctacggctattactactactacggtatggacgtctggggccaagggaccacggtcaccgtctcctca

SEQ ID NO: 418 - protein, 124 aa, Artificial Sequence
  synthetic
EVQLVESGGGLVQPGGSLRLSCAASGFSFDDYTMHWVRQPPGKGLEWVSGISWNSGSIGYADSVKGRFTISRDNAKNSLYLQMNSLRAGDTALYYCAKDNSGYGYYYYYGMDVWGQGTTVTVSS

SEQ ID NO: 419 - DNA, 24 bp, Artificial Sequence
  synthetic
ggattctcctttgatgattatacc

SEQ ID NO: 420 - protein, 8 aa, Artificial Sequence
  synthetic
GFSFDDYT

SEQ ID NO: 421 - DNA, 24 bp, Artificial Sequence
  synthetic
attagttggaatagtggtagcata

SEQ ID NO: 422 - protein, 8 aa, Artificial Sequence
  synthetic
ISWNSGSI

SEQ ID NO: 423 - DNA, 51 bp, Artificial Sequence
  synthetic
gcaaaagataatagtggctacggctattactactactacggtatggacgtc

SEQ ID NO: 424 - protein, 17 aa, Artificial Sequence
  synthetic
AKDNSGYGYYYYYGMDV

SEQ ID NO: 425 - DNA, 321 bp, Artificial Sequence
  synthetic
gaaatagtgatgacgcagtctccagccaccctgtctgtgtctccaggggaaagagccaccctctcctgcagggccagtcagagtgttagcagcaacttagcctggtaccagcagaaacctggccaggctcccagactcctcatctatggtgcatccaccagggccactggtatcccagccaggttcagtggcagtgggtctgggacagaattcactctcaccatcagcagcctgcagtctgaagattttgcagtttattactgtcagcagtattataactggcctctcactttcggcggagggaccaaggtggagatcaaa

SEQ ID NO: 426 - protein, 107 aa, Artificial Sequence
  synthetic
EIVMTQSPATLSVSPGERATLSCRASQSVSSNLAWYQQKPGQAPRLLIYGASTRATGIPARFSGSGSGTEFTLTISSLQSEDFAVYYCQQYYNWPLTFGGGTKVEIK

SEQ ID NO: 427 - DNA, 18 bp, Artificial Sequence
  synthetic
cagagtgttagcagcaac

SEQ ID NO: 428 - protein, 6 aa, Artificial Sequence
  synthetic
QSVSSN

SEQ ID NO: 429 - DNA, 9 bp, Artificial Sequence
  synthetic
ggtgcatcc

SEQ ID NO: 430 - protein, 3 aa, Artificial Sequence
  synthetic
GAS

SEQ ID NO: 431 - DNA, 27 bp, Artificial Sequence
  synthetic
cagcagtattataactggcctctcact

SEQ ID NO: 432 - protein, 9 aa, Artificial Sequence
  synthetic
QQYYNWPLT

SEQ ID NO: 433 - DNA, 372 bp, Artificial Sequence
  synthetic
gaagtacagctggtggagtctgggggaggcttggtacagcctggcaggtccctgagactctcctgtgtagcctctggattcccctttgctgattataccatgcactgggtccggcaagctccagggaagggcctggagtgggtctcagatattagttggaatagtggtagcaaaggctatgcggactctgtgaagggccgattcaccatctccagagacaatgccaagaactccctgtatctgcaaatgaacagtctgagaactgaggacacggccttctattactgtgcaaaagatatgagtggctacgcccactacttctactacggtatggacgtctggggccaagggaccacggtcaccgtctcctca

SEQ ID NO: 434 - protein, 124 aa, Artificial Sequence
  synthetic
EVQLVESGGGLVQPGRSLRLSCVASGFPFADYTMHWVRQAPGKGLEWVSDISWNSGSKGYADSVKGRFTISRDNAKNSLYLQMNSLRTEDTAFYYCAKDMSGYAHYFYYGMDVWGQGTTVTVSS

SEQ ID NO: 435 - DNA, 24 bp, Artificial Sequence
  synthetic
ggattcccctttgctgattatacc

SEQ ID NO: 436 - protein, 8 aa, Artificial Sequence
  synthetic
GFPFADYT

SEQ ID NO: 437 - DNA, 24 bp, Artificial Sequence
  synthetic
attagttggaatagtggtagcaaa

SEQ ID NO: 438 - protein, 8 aa, Artificial Sequence
  synthetic
ISWNSGSK

SEQ ID NO: 439 - DNA, 51 bp, Artificial Sequence
  synthetic
gcaaaagatatgagtggctacgcccactacttctactacggtatggacgtc

SEQ ID NO: 440 - protein, 17 aa, Artificial Sequence
  synthetic
AKDMSGYAHYFYYGMDV

SEQ ID NO: 441 - DNA, 324 bp, Artificial Sequence
  synthetic
gacatccagatgacccagtctccatcctccctgtctgcatctgtaggagacagagtcaccatcacttgccggccaagtcagagcattagcagctatttaaattggtttcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 442 - protein, 108 aa, Artificial Sequence
  synthetic
DIQMTQSPSSLSASVGDRVTITCRPSQSISSYLNWFQQKPGKAPKLLIYAASSLQSGVPSRFSGSGSGTDFTLTISSLQPEDFATYYCQQSYSTPPITFGQGTRLEIK

SEQ ID NO: 443 - DNA, 18 bp, Artificial Sequence
  synthetic
cagagcattagcagctat

SEQ ID NO: 444 - protein, 6 aa, Artificial Sequence
  synthetic
QSISSY

SEQ ID NO: 445 - DNA, 9 bp, Artificial Sequence
  synthetic
gctgcatcc

SEQ ID NO: 446 - protein, 3 aa, Artificial Sequence
  synthetic
AAS

SEQ ID NO: 447 - DNA, 30 bp, Artificial Sequence; identical to SEQ ID NO: 31
  synthetic

SEQ ID NO: 448 - protein, 10 aa, Artificial Sequence
  synthetic
QQSYSTPPIT

SEQ ID NO: 449 - DNA, 372 bp, Artificial Sequence
  synthetic
gaagtacaactggtggagtctgggggaggcttggtacagcctggcaggtccctaagactctcctgtgcagcctctggattcacctttgatgattataccatgcactgggtccggcaagttccagggaagggcctggagtgggtctcaggtattagttggaatagtggcagcttggcctacgcggactctgtgaagggccgattcaccatctccagagacaacgccaagaattccctgtatctgcaaatgaacagtcttcaccctgaggacacggccctctattactgtgtaaaagatggtagtggctacggccactactcctactacggtttggacgtctggggccaggggaccacggtcaccgtctcctca

SEQ ID NO: 450 - protein, 124 aa, Artificial Sequence
  synthetic
EVQLVESGGGLVQPGRSLRLSCAASGFTFDDYTMHWVRQVPGKGLEWVSGISWNSGSLAYADSVKGRFTISRDNAKNSLYLQMNSLHPEDTALYYCVKDGSGYGHYSYYGLDVWGQGTTVTVSS

SEQ ID NO: 451 - DNA, 24 bp, Artificial Sequence
  synthetic
ggattcacctttgatgattatacc

SEQ ID NO: 452 - protein, 8 aa, Artificial Sequence
  synthetic
GFTFDDYT

SEQ ID NO: 453 - DNA, 24 bp, Artificial Sequence
  synthetic
attagttggaatagtggcagcttg

SEQ ID NO: 454 - protein, 8 aa, Artificial Sequence
  synthetic
ISWNSGSL

SEQ ID NO: 455 - DNA, 51 bp, Artificial Sequence
  synthetic
gtaaaagatggtagtggctacggccactactcctactacggtttggacgtc

SEQ ID NO: 456 - protein, 17 aa, Artificial Sequence
  synthetic
VKDGSGYGHYSYYGLDV

SEQ ID NO: 457 - DNA, 324 bp, Artificial Sequence
  synthetic
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagttcaccttggacgttcggccaagggaccaaggtggaaatcaaa

SEQ ID NO: 458 - protein, 108 aa, Artificial Sequence; identical to SEQ ID NO: 170
  synthetic

SEQ ID NO: 459 - DNA, 21 bp, Artificial Sequence
  synthetic
cagagtgttagcagcagctac

SEQ ID NO: 460 - protein, 7 aa, Artificial Sequence
  synthetic
QSVSSSY

SEQ ID NO: 461 - DNA, 9 bp, Artificial Sequence
  synthetic
ggtgcatcc

SEQ ID NO: 462 - protein, 3 aa, Artificial Sequence
  synthetic
GAS

SEQ ID NO: 463 - DNA, 27 bp, Artificial Sequence
  synthetic
cagcagtatggtagttcaccttggacg

SEQ ID NO: 464 - protein, 9 aa, Artificial Sequence
  synthetic
QQYGSSPWT

SEQ ID NO: 465 - DNA, 372 bp, Artificial Sequence
  synthetic
gaagtacagctggtggagtctgggggaggcttggtacagcctggcaggtccctgagactctcctgtgtagcctctggattcccctttgctgattataccatgcactgggtccggcaagctccagggaagggcctggagtgggtctcagatattagttggaatagtggtagcataggctatgcggactctgtgaagggccgattcaccatctccagagacaatgccaagaactccctgtatctgcaaatgaacagtctgagaactgaggacacggccttgtattactgtgcaaaagatatgagtggctacgcccactacttctactacggtatggacgtctggggccaagggaccacggtcaccgtctcctca

SEQ ID NO: 466 - protein, 124 aa, Artificial Sequence
  synthetic
EVQLVESGGGLVQPGRSLRLSCVASGFPFADYTMHWVRQAPGKGLEWVSDISWNSGSIGYADSVKGRFTISRDNAKNSLYLQMNSLRTEDTALYYCAKDMSGYAHYFYYGMDVWGQGTTVTVSS

SEQ ID NO: 467 - DNA, 24 bp, Artificial Sequence
  synthetic
ggattcccctttgctgattatacc

SEQ ID NO: 468 - protein, 8 aa, Artificial Sequence
  synthetic
GFPFADYT

SEQ ID NO: 469 - DNA, 24 bp, Artificial Sequence
  synthetic
attagttggaatagtggtagcata

SEQ ID NO: 470 - protein, 8 aa, Artificial Sequence
  synthetic
ISWNSGSI

SEQ ID NO: 471 - DNA, 51 bp, Artificial Sequence; identical to SEQ ID NO: 439
  synthetic

SEQ ID NO: 472 - protein, 17 aa, Artificial Sequence
  synthetic
AKDMSGYAHYFYYGMDV

SEQ ID NO: 473 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 474 - protein, 108 aa, Artificial Sequence
  synthetic
DIQMTQSPSSLSASVGDRVTITCRASQSISSYLNWYQQKPGKAPKLLIFAASSLQSGVPSRFSGSGSGTDFTLTISSLQPEDFATYYCQQSYSTPPITFGQGTRLEIK

SEQ ID NO: 475 - DNA, 18 bp, Artificial Sequence
  synthetic
cagagcattagcagctat

SEQ ID NO: 476 - protein, 6 aa, Artificial Sequence
  synthetic
QSISSY

SEQ ID NO: 477 - DNA, 9 bp, Artificial Sequence
  synthetic
gctgcatcc

SEQ ID NO: 478 - protein, 3 aa, Artificial Sequence
  synthetic
AAS

SEQ ID NO: 479 - DNA, 30 bp, Artificial Sequence; identical to SEQ ID NO: 31
  synthetic

SEQ ID NO: 480 - protein, 10 aa, Artificial Sequence
  synthetic
QQSYSTPPIT

SEQ ID NO: 481 - DNA, 372 bp, Artificial Sequence
  synthetic
gaagtgcagctggtggagtctgggggaggcttggtacagcctggcaggtccctgaaactctcctgtacagcctctggattcacctttgctgattataccatgcactgggtccgacaaggtccagggaagggcctggagtgggtctcagatattagttggaatagtggtagtaaaggctatgcggactctgtgaagggccgattcaccatctccagagacaacgccaagaactccctgtatctgcaaatgaacagtctgagaactgaggacacggccttgtattactgtgcaaaagatatgagtggctacgcccactactactactacgctttggacgtctggggccaagggaccacggtcaccgtctcctca

SEQ ID NO: 482 - protein, 124 aa, Artificial Sequence
  synthetic
EVQLVESGGGLVQPGRSLKLSCTASGFTFADYTMHWVRQGPGKGLEWVSDISWNSGSKGYADSVKGRFTISRDNAKNSLYLQMNSLRTEDTALYYCAKDMSGYAHYYYYALDVWGQGTTVTVSS

SEQ ID NO: 483 - DNA, 24 bp, Artificial Sequence
  synthetic
ggattcacctttgctgattatacc

SEQ ID NO: 484 - protein, 8 aa, Artificial Sequence
  synthetic
GFTFADYT

SEQ ID NO: 485 - DNA, 24 bp, Artificial Sequence
  synthetic
attagttggaatagtggtagtaaa

SEQ ID NO: 486 - protein, 8 aa, Artificial Sequence
  synthetic
ISWNSGSK

SEQ ID NO: 487 - DNA, 51 bp, Artificial Sequence
  synthetic
gcaaaagatatgagtggctacgcccactactactactacgctttggacgtc

SEQ ID NO: 488 - protein, 17 aa, Artificial Sequence
  synthetic
AKDMSGYAHYYYYALDV

SEQ ID NO: 489 - DNA, 324 bp, Artificial Sequence
  synthetic
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaaccccccgatcaccttcggccaagggacacgactggagattaaa

SEQ ID NO: 490 - protein, 108 aa, Artificial Sequence
  synthetic
DIQMTQSPSSLSASVGDRVTITCRASQSISNYLNWYQQKPGKAPKLLIYAASSLQSGVPSRFSGSGSGTDFTLTISSLQPEDFATYYCQQSYSNPPITFGQGTRLEIK

SEQ ID NO: 491 - DNA, 18 bp, Artificial Sequence
  synthetic
cagagcattagcaactat

SEQ ID NO: 492 - protein, 6 aa, Artificial Sequence
  synthetic
QSISNY

SEQ ID NO: 493 - DNA, 9 bp, Artificial Sequence
  synthetic
gctgcatcc

SEQ ID NO: 494 - protein, 3 aa, Artificial Sequence
  synthetic
AAS

SEQ ID NO: 495 - DNA, 30 bp, Artificial Sequence
  synthetic
caacagagttacagtaaccccccgatcacc

SEQ ID NO: 496 - protein, 10 aa, Artificial Sequence
  synthetic
QQSYSNPPIT

SEQ ID NO: 497 - DNA, 363 bp, Artificial Sequence
  synthetic
caggtgcagctggtggagtctgggggaggcgtggtccagcctgggaggtccctgagactctcctgtgcagcctctggattcaccttcagtagaaaaggcatgcactgggtccgccaggctccagtcaaggggctggagtgggtggcagttatatcatatgatggaagtaataaatactatgcagactccgtgaagggccgattcaccatctccagagacaattccaagaacacgctgtatctgcaaatgaacagcctgacagctgaggacacggctgtgtattactgtgcgaaagaaggggggcatgactatggtggtacctttgactactggggccagggaaccctggtcaccgtctcctca

SEQ ID NO: 498 - protein, 121 aa, Artificial Sequence
  synthetic
QVQLVESGGGVVQPGRSLRLSCAASGFTFSRKGMHWVRQAPVKGLEWVAVISYDGSNKYYADSVKGRFTISRDNSKNTLYLQMNSLTAEDTAVYYCAKEGGHDYGGTFDYWGQGTLVTVSS

SEQ ID NO: 499 - DNA, 24 bp, Artificial Sequence
  synthetic
ggattcaccttcagtagaaaaggc

SEQ ID NO: 500 - protein, 8 aa, Artificial Sequence
  synthetic
GFTFSRKG

SEQ ID NO: 501 - DNA, 24 bp, Artificial Sequence
  synthetic
atatcatatgatggaagtaataaa

SEQ ID NO: 502 - protein, 8 aa, Artificial Sequence
  synthetic
ISYDGSNK

SEQ ID NO: 503 - DNA, 42 bp, Artificial Sequence
  synthetic
gcgaaagaaggggggcatgactatggtggtacctttgactac

SEQ ID NO: 504 - protein, 14 aa, Artificial Sequence
  synthetic
AKEGGHDYGGTFDY

SEQ ID NO: 505 - DNA, 321 bp, Artificial Sequence
  synthetic
gacatccagatgacccagtctccatcctccctgtctgcatctgtaggagacagagtcaccatcacttgccaggcgagtcaggacattaacaactatttaaattggtatcagcagaaaccagggaaagcccctaagttcctgatctacgatgcatccaatttggaaacaggggtcccatcaaggttcagtggaagtggatctgggacagattttactttcaccatcagcagcctgcagcctgaagatattgcaacatattactgtcaacagtatgatgatctcccattcactttcggccctgggaccaaagtggatatcaaa

SEQ ID NO: 506 - protein, 107 aa, Artificial Sequence
  synthetic
DIQMTQSPSSLSASVGDRVTITCQASQDINNYLNWYQQKPGKAPKFLIYDASNLETGVPSRFSGSGSGTDFTFTISSLQPEDIATYYCQQYDDLPFTFGPGTKVDIK

SEQ ID NO: 507 - DNA, 18 bp, Artificial Sequence
  synthetic
caggacattaacaactat

SEQ ID NO: 508 - protein, 6 aa, Artificial Sequence
  synthetic
QDINNY

SEQ ID NO: 509 - DNA, 9 bp, Artificial Sequence
  synthetic
gatgcatcc

SEQ ID NO: 510 - protein, 3 aa, Artificial Sequence
  synthetic
DAS

SEQ ID NO: 511 - DNA, 27 bp, Artificial Sequence
  synthetic
caacagtatgatgatctcccattcact

SEQ ID NO: 512 - protein, 9 aa, Artificial Sequence
  synthetic
QQYDDLPFT

SEQ ID NO: 513 - DNA, 369 bp, Artificial Sequence
  synthetic
gaagtgcagctggtggagtctgggggaggcttggtacagcctggcaggtccctgagactctcctgtgcagcctctggattcacctttgatgattataccatgcactgggtccggcaagctccagggaagggcctggagtgggtctcaggtattagttggaatagtggtagtataggctatgcggactctgtgaagggccgattcaccatctccagagacaacgccaagaagtccctgtatctgcaaatgaacagtctgagagctgaggacacggccttgtattactgtgcaaaagataatagtggctacggtcactactactacggaatggacgtctggggccaagggaccacggtcaccgtcgcctca

SEQ ID NO: 514 - protein, 123 aa, Artificial Sequence
  synthetic
EVQLVESGGGLVQPGRSLRLSCAASGFTFDDYTMHWVRQAPGKGLEWVSGISWNSGSIGYADSVKGRFTISRDNAKKSLYLQMNSLRAEDTALYYCAKDNSGYGHYYYGMDVWGQGTTVTVAS

SEQ ID NO: 515 - DNA, 24 bp, Artificial Sequence
  synthetic
ggattcacctttgatgattatacc

SEQ ID NO: 516 - protein, 8 aa, Artificial Sequence
  synthetic
GFTFDDYT

SEQ ID NO: 517 - DNA, 24 bp, Artificial Sequence
  synthetic
attagttggaatagtggtagtata

SEQ ID NO: 518 - protein, 8 aa, Artificial Sequence
  synthetic
ISWNSGSI

SEQ ID NO: 519 - DNA, 48 bp, Artificial Sequence
  synthetic
gcaaaagataatagtggctacggtcactactactacggaatggacgtc

SEQ ID NO: 520 - protein, 16 aa, Artificial Sequence
  synthetic
AKDNSGYGHYYYGMDV

SEQ ID NO: 521 - DNA, 321 bp, Artificial Sequence
  synthetic
gaaatagtgatgacgcagtctccagccaccctgtctgtgtctccaggggaaagagccaccctctcctgcagggccagtcagagtgttagcagcaacttagcctggtaccagcaaaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcactatattaactggcctctcactttcggcggagggaccaaggtggagatcaaa

SEQ ID NO: 522 - protein, 107 aa, Artificial Sequence
  synthetic
EIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 523 - DNA, 18 bp, Artificial Sequence
  synthetic
cagagtgttagcagcaac

SEQ ID NO: 524 - protein, 6 aa, Artificial Sequence
  synthetic
QSVSSN

SEQ ID NO: 525 - DNA, 9 bp, Artificial Sequence
  synthetic
ggtgcatcc

SEQ ID NO: 526 - protein, 3 aa, Artificial Sequence
  synthetic
GAS

SEQ ID NO: 527 - DNA, 27 bp, Artificial Sequence
  synthetic
cagcactatattaactggcctctcact

SEQ ID NO: 528 - protein, 9 aa, Artificial Sequence
  synthetic
QHYINWPLT

SEQ ID NO: 529 - DNA, 369 bp, Artificial Sequence; identical to SEQ ID NO: 513
  synthetic

SEQ ID NO: 530 - protein, 123 aa, Artificial Sequence; identical to SEQ ID NO: 514
  synthetic

SEQ ID NO: 531 - DNA, 24 bp, Artificial Sequence
  synthetic
ggattcacctttgatgattatacc

SEQ ID NO: 532 - protein, 8 aa, Artificial Sequence
  synthetic
GFTFDDYT

SEQ ID NO: 533 - DNA, 24 bp, Artificial Sequence
  synthetic
attagttggaatagtggtagtata

SEQ ID NO: 534 - protein, 8 aa, Artificial Sequence
  synthetic
ISWNSGSI

SEQ ID NO: 535 - DNA, 48 bp, Artificial Sequence; identical to SEQ ID NO: 519
  synthetic

SEQ ID NO: 536 - protein, 16 aa, Artificial Sequence
  synthetic
AKDNSGYGHYYYGMDV

SEQ ID NO: 537 - DNA, 321 bp, Artificial Sequence; identical to SEQ ID NO: 521
  synthetic

SEQ ID NO: 538 - protein, 107 aa, Artificial Sequence; identical to SEQ ID NO: 522
  synthetic

SEQ ID NO: 539 - DNA, 18 bp, Artificial Sequence
  synthetic
cagagtgttagcagcaac

SEQ ID NO: 540 - protein, 6 aa, Artificial Sequence
  synthetic
QSVSSN

SEQ ID NO: 541 - DNA, 9 bp, Artificial Sequence
  synthetic
ggtgcatcc

SEQ ID NO: 542 - protein, 3 aa, Artificial Sequence
  synthetic
GAS

SEQ ID NO: 543 - DNA, 27 bp, Artificial Sequence
  synthetic
cagcactatattaactggcctctcact

SEQ ID NO: 544 - protein, 9 aa, Artificial Sequence
  synthetic
QHYINWPLT

SEQ ID NO: 545 - DNA, 354 bp, Artificial Sequence
  synthetic
caggtgcagttggtggagtctgggggaggcgtggtccagcctgggaggtccctgagactctcctgtggtgcgtctggattcaccttcagaagttatggcatgcactgggtccgccagactccaggcagggggctggagtgggtggcaatgatatattatgatggaaataataaatactatgcagactccgtgaggggccgattcaccgtttccagagacaattccaagaacaccctgtatctgcaaatgagcagcctgagagccgaggacacggctctatatttctgtgcgcgagggcctgggtacaactggctcgacccctggggccagggaaccctggtcaccgtctcctca

SEQ ID NO: 546 - protein, 118 aa, Artificial Sequence
  synthetic
QVQLVESGGGVVQPGRSLRLSCGASGFTFRSYGMHWVRQTPGRGLEWVAMIYYDGNNKYYADSVRGRFTVSRDNSKNTLYLQMSSLRAEDTALYFCARGPGYNWLDPWGQGTLVTVSS

SEQ ID NO: 547 - DNA, 24 bp, Artificial Sequence
  synthetic
ggattcaccttcagaagttatggc

SEQ ID NO: 548 - protein, 8 aa, Artificial Sequence
  synthetic
GFTFRSYG

SEQ ID NO: 549 - DNA, 24 bp, Artificial Sequence
  synthetic
atatattatgatggaaataataaa

SEQ ID NO: 550 - protein, 8 aa, Artificial Sequence
  synthetic
IYYDGNNK

SEQ ID NO: 551 - DNA, 33 bp, Artificial Sequence
  synthetic
gcgcgagggcctgggtacaactggctcgacccc

SEQ ID NO: 552 - protein, 11 aa, Artificial Sequence
  synthetic
ARGPGYNWLDP

SEQ ID NO: 553 - DNA, 321 bp, Artificial Sequence
  synthetic
gaaatagtgatgacgcagtctccagccaccctgtctgtgtctccaggggaaagagccaccctctcctgcagggccagtcagagtattagcaggaacttggcctggtaccagcaraaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataaccggcctctcactttcggcggagggaccgaggtggagatcaaa

SEQ ID NO: 554 - protein, 107 aa, Artificial Sequence
  synthetic
  VARIANT (38)..(38): Xaa = Any Amino Acid
EIVMTQSPATLSVSPGERATLSCRASQSISRNLAWYQXKPGQAPRLLIYGASTRATGIPARFSGSGSGTEFTLTISSLQSEDFAVYYCQQYNNRPLTFGGGTEVEIK

SEQ ID NO: 555 - DNA, 18 bp, Artificial Sequence
  synthetic
cagagtattagcaggaac

SEQ ID NO: 556 - protein, 6 aa, Artificial Sequence
  synthetic
QSISRN

SEQ ID NO: 557 - DNA, 9 bp, Artificial Sequence
  synthetic
ggtgcatcc

SEQ ID NO: 558 - protein, 3 aa, Artificial Sequence
  synthetic
GAS

SEQ ID NO: 559 - DNA, 27 bp, Artificial Sequence
  synthetic
cagcagtataataaccggcctctcact

SEQ ID NO: 560 - protein, 9 aa, Artificial Sequence
  synthetic
QQYNNRPLT

SEQ ID NO: 561 - DNA, 354 bp, Artificial Sequence
  synthetic
caggtgcagttggtggagtctgggggaggcgtggtccagcctgggaggtccctgagactcgcctgtgttgcgtctggattcaccttcagaagttatggcatgcactgggtccgccaggctccaggcaagggactgcagtgggtggcaatgatttactatgatggtaagaataaatattatgcagactccgtgaggggccgattcaccatctccagagacaattccaagaacacactgtatctgcaaatgaacaatctgagagtcgaggacacggctatgtatttctgtgcgcgagggcctgggtacaattggctcgacccctggggccagggaaccctggtcactgtttcctca

SEQ ID NO: 562 - protein, 118 aa, Artificial Sequence
  synthetic
QVQLVESGGGVVQPGRSLRLACVASGFTFRSYGMHWVRQAPGKGLQWVAMIYYDGKNKYYADSVRGRFTISRDNSKNTLYLQMNNLRVEDTAMYFCARGPGYNWLDPWGQGTLVTVSS

SEQ ID NO: 563 - DNA, 24 bp, Artificial Sequence
  synthetic
ggattcaccttcagaagttatggc

SEQ ID NO: 564 - protein, 8 aa, Artificial Sequence
  synthetic
GFTFRSYG

SEQ ID NO: 565 - DNA, 24 bp, Artificial Sequence
  synthetic
atttactatgatggtaagaataaa

SEQ ID NO: 566 - protein, 8 aa, Artificial Sequence
  synthetic
IYYDGKNK

SEQ ID NO: 567 - DNA, 33 bp, Artificial Sequence
  synthetic
gcgcgagggcctgggtacaattggctcgacccc

SEQ ID NO: 568 - protein, 11 aa, Artificial Sequence
  synthetic
ARGPGYNWLDP

SEQ ID NO: 569 - DNA, 321 bp, Artificial Sequence
  synthetic
gaaatagtgatgacgcagtctccagccaccctgtctgtgtctccaggggaaagagccaccctctcctgcagggccagtcagagaattagcagcaacttggcctggtaccagcaaaaacctggccaggctcccaggctcctcatctatggtgcatccaccagggccactggtagcccagccaggttcagtggcagtgggtctgggacagacttcactctcaccatcagcagcctgcagtctgaggatgttgcagtttattactgtcagcaacatcataactggcctctcactttcggcggagggaccaaggtggagatcaaa

SEQ ID NO: 570 - protein, 107 aa, Artificial Sequence
  synthetic
EIVMTQSPATLSVSPGERATLSCRASQRISSNLAWYQQKPGQAPRLLIYGASTRATGSPARFSGSGSGTDFTLTISSLQSEDVAVYYCQQHHNWPLTFGGGTKVEIK

SEQ ID NO: 571 - DNA, 18 bp, Artificial Sequence
  synthetic
cagagaattagcagcaac

SEQ ID NO: 572 - protein, 6 aa, Artificial Sequence
  synthetic
QRISSN

SEQ ID NO: 573 - DNA, 9 bp, Artificial Sequence
  synthetic
ggtgcatcc

SEQ ID NO: 574 - protein, 3 aa, Artificial Sequence
  synthetic
GAS

SEQ ID NO: 575 - DNA, 27 bp, Artificial Sequence
  synthetic
cagcaacatcataactggcctctcact

SEQ ID NO: 576 - protein, 9 aa, Artificial Sequence
  synthetic
QQHHNWPLT

SEQ ID NO: 577 - DNA, 354 bp, Artificial Sequence
  synthetic
caggtgcagctggtggagtctgggggaggcgtggtccagcctgggaggtccctgagactctcctgtgctgcgtctggatttaccttcagaagttatgccatgcactgggtccgccaggctccaggcaaggggctggagtgggtggcaatggtatactatgatggaaataatcaatactatgcagactccgtgaggggccgattcaccatctccagagacaattccaagaacacgctgtatctgcaaatgaacagcctgagagccgatgacacggctgtgtatttctgtgcgcgagggcctgggtacaactggctcgacccctggggccagggaaccctggtcaccgtctcctca

SEQ ID NO: 578 - protein, 118 aa, Artificial Sequence
  synthetic
QVQLVESGGGVVQPGRSLRLSCAASGFTFRSYAMHWVRQAPGKGLEWVAMVYYDGNNQYYADSVRGRFTISRDNSKNTLYLQMNSLRADDTAVYFCARGPGYNWLDPWGQGTLVTVSS

SEQ ID NO: 579 - DNA, 24 bp, Artificial Sequence
  synthetic
ggatttaccttcagaagttatgcc

SEQ ID NO: 580 - protein, 8 aa, Artificial Sequence
  synthetic
GFTFRSYA

SEQ ID NO: 581 - DNA, 24 bp, Artificial Sequence
  synthetic
gtatactatgatggaaataatcaa

SEQ ID NO: 582 - protein, 8 aa, Artificial Sequence
  synthetic
VYYDGNNQ

SEQ ID NO: 583 - DNA, 33 bp, Artificial Sequence; identical to SEQ ID NO: 551
  synthetic

SEQ ID NO: 584 - protein, 11 aa, Artificial Sequence
  synthetic
ARGPGYNWLDP

SEQ ID NO: 585 - DNA, 321 bp, Artificial Sequence
  synthetic
gaaatagtgatgacgcagtctccagccaccctgtctgtgtctccaggggaaagagccaccctctcctgcagggccagtcagagtgttagcaggaacttggcctggtaccagcaaaaacctggccaggctcccaggctcctcatctatggtgcatccaccagggccactggtatcccggccaggttcagtggcagtgggtctgggacagacttcactctcaccatcagcagcctgcagtctgaagattttgcagtttattactgtcagcagtataataactggcctctcactttcggcggagggaccaaggtggtgatcaaa

SEQ ID NO: 586 - protein, 107 aa, Artificial Sequence
  synthetic
EIVMTQSPATLSVSPGERATLSCRASQSVSRNLAWYQQKPGQAPRLLIYGASTRATGIPARFSGSGSGTDFTLTISSLQSEDFAVYYCQQYNNWPLTFGGGTKVVIK

SEQ ID NO: 587 - DNA, 18 bp, Artificial Sequence
  synthetic
cagagtgttagcaggaac

SEQ ID NO: 588 - protein, 6 aa, Artificial Sequence
  synthetic
QSVSRN

SEQ ID NO: 589 - DNA, 9 bp, Artificial Sequence
  synthetic
ggtgcatcc

SEQ ID NO: 590 - protein, 3 aa, Artificial Sequence
  synthetic
GAS

SEQ ID NO: 591 - DNA, 27 bp, Artificial Sequence
  synthetic
cagcagtataataactggcctctcact

SEQ ID NO: 592 - protein, 9 aa, Artificial Sequence
  synthetic
QQYNNWPLT

SEQ ID NO: 593 - DNA, 354 bp, Artificial Sequence
  synthetic
caggtgcagctggtggagtctgggggaggcgtggtccagcctgggaggtccctgagactctcctgtattgcgtctggatttaccttcagaagttatggcatgcactgggtccgccaggctccaggcaaggggctggagtgggtggcaatgatatattatgatggaaacaataaatactatgcagactccgtgaggggccgattcaccatctccagagacaactccaagaacacgctgtatctgcaaatgaacagcctgagagccgatgacacggctgtgtatttctgtgcgcgagggcctgggtacaactggctcgacccctggggccagggaaccctggtcaccgtctcctca

SEQ ID NO: 594 - protein, 118 aa, Artificial Sequence
  synthetic
QVQLVESGGGVVQPGRSLRLSCIASGFTFRSYGMHWVRQAPGKGLEWVAMIYYDGNNKYYADSVRGRFTISRDNSKNTLYLQMNSLRADDTAVYFCARGPGYNWLDPWGQGTLVTVSS

SEQ ID NO: 595 - DNA, 24 bp, Artificial Sequence
  synthetic
ggatttaccttcagaagttatggc

SEQ ID NO: 596 - protein, 8 aa, Artificial Sequence
  synthetic
GFTFRSYG

SEQ ID NO: 597 - DNA, 24 bp, Artificial Sequence
  synthetic
atatattatgatggaaacaataaa

SEQ ID NO: 598 - protein, 8 aa, Artificial Sequence
  synthetic
IYYDGNNK

SEQ ID NO: 599 - DNA, 33 bp, Artificial Sequence; identical to SEQ ID NO: 551
  synthetic

SEQ ID NO: 600 - protein, 11 aa, Artificial Sequence
  synthetic
ARGPGYNWLDP

SEQ ID NO: 601 - DNA, 321 bp, Artificial Sequence
  synthetic
gaaatagtgatgacgcagtctccagccacactgtctgtgtctccaggggaaagagccaccctctcctgcagggccagtcagagtgttagcagcaacttggcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataacaggcctctcactttcggcggagggaccaaggtggagatcaaa

SEQ ID NO: 602 - protein, 107 aa, Artificial Sequence
  synthetic
EIVMTQSPATLSVSPGERATLSCRASQSVSSNLAWYQQKPGQAPRLLIYGASTRATGIPARFSGSGSGTEFTLTISSLQSEDFAVYYCQQYNNRPLTFGGGTKVEIK

SEQ ID NO: 603 - DNA, 18 bp, Artificial Sequence
  synthetic
cagagtgttagcagcaac

SEQ ID NO: 604 - protein, 6 aa, Artificial Sequence
  synthetic
QSVSSN

SEQ ID NO: 605 - DNA, 9 bp, Artificial Sequence
  synthetic
ggtgcatcc

SEQ ID NO: 606 - protein, 3 aa, Artificial Sequence
  synthetic
GAS

SEQ ID NO: 607 - DNA, 27 bp, Artificial Sequence
  synthetic
cagcagtataataacaggcctctcact

SEQ ID NO: 608 - protein, 9 aa, Artificial Sequence
  synthetic
QQYNNRPLT

SEQ ID NO: 609 - DNA, 354 bp, Artificial Sequence
  synthetic
caggtgcagctggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 610 - protein, 118 aa, Artificial Sequence
  synthetic
QVQLVESGGGVVQPGRSLRLSCAASGFTFRSFGMHWVRQAPGRGLEWVAMIYFDGKNKYYADSVRGRFTISRDNSKNTLYLEMSSLRAEDTAVYFCARGPGYNWLDPWGQGTLVTVSS

SEQ ID NO: 611 - DNA, 24 bp, Artificial Sequence
  synthetic
ggattcaccttcagaagttttggc

SEQ ID NO: 612 - protein, 8 aa, Artificial Sequence
  synthetic
GFTFRSFG

SEQ ID NO: 613 - DNA, 24 bp, Artificial Sequence
  synthetic
atatattttgatggaaaaaataaa

SEQ ID NO: 614 - protein, 8 aa, Artificial Sequence
  synthetic
IYFDGKNK

SEQ ID NO: 615 - DNA, 33 bp, Artificial Sequence; identical to SEQ ID NO: 551
  synthetic

SEQ ID NO: 616 - protein, 11 aa, Artificial Sequence
  synthetic
ARGPGYNWLDP

SEQ ID NO: 617 - DNA, 321 bp, Artificial Sequence
  synthetic
gaaatagtgatgacgcagtctccagccaccctgtctgtgtctccaggggaaagagtcaccctctcctgtagggccagtcagagtattagcaggaacttggcctggtaccagcagaaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 618 - protein, 107 aa, Artificial Sequence
  synthetic
EIVMTQSPATLSVSPGERVTLSCRASQSISRNLAWYQQKPGQAPRLLIYGASTRATGVPARFSGSGSGTEFTLTISSLQSEDFAVFHCQQYNNRPLTFGGGTEVEIK

SEQ ID NO: 619 - DNA, 18 bp, Artificial Sequence
  synthetic
cagagtattagcaggaac

SEQ ID NO: 620 - protein, 6 aa, Artificial Sequence
  synthetic
QSISRN

SEQ ID NO: 621 - DNA, 9 bp, Artificial Sequence
  synthetic
ggtgcatcc

SEQ ID NO: 622 - protein, 3 aa, Artificial Sequence
  synthetic
GAS

SEQ ID NO: 623 - DNA, 27 bp, Artificial Sequence
  synthetic
cagcagtataataataggcctctcact

SEQ ID NO: 624 - protein, 9 aa, Artificial Sequence
  synthetic
QQYNNRPLT

SEQ ID NO: 625 - DNA, 354 bp, Artificial Sequence
  synthetic
caggtgcaattggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 626 - protein, 118 aa, Artificial Sequence; identical to SEQ ID NO: 610
  synthetic

SEQ ID NO: 627 - DNA, 24 bp, Artificial Sequence
  synthetic
ggattcaccttcagaagttttggc

SEQ ID NO: 628 - protein, 8 aa, Artificial Sequence
  synthetic
GFTFRSFG

SEQ ID NO: 629 - DNA, 24 bp, Artificial Sequence
  synthetic
atatattttgatggaaaaaataaa

SEQ ID NO: 630 - protein, 8 aa, Artificial Sequence
  synthetic
IYFDGKNK

SEQ ID NO: 631 - DNA, 33 bp, Artificial Sequence; identical to SEQ ID NO: 551
  synthetic

SEQ ID NO: 632 - protein, 11 aa, Artificial Sequence
  synthetic
ARGPGYNWLDP

SEQ ID NO: 633 - DNA, 321 bp, Artificial Sequence
  synthetic
gaaatagtgatgacgcagtctccagccaccctgtctgtgtctccaggggaaagagtcaccctctcctgtagggccagtcagagtattagcaggaacttggcctggtaccagcaraaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 634 - protein, 107 aa, Artificial Sequence
  synthetic
  VARIANT (38)..(38): Xaa = Any Amino Acid
EIVMTQSPATLSVSPGERVTLSCRASQSISRNLAWYQXKPGQAPRLLIYGASTRATGVPARFSGSGSGTEFTLTISSLQSEDFAVFHCQQYNNRPLTFGGGTEVEIK

SEQ ID NO: 635 - DNA, 18 bp, Artificial Sequence
  synthetic
cagagtattagcaggaac

SEQ ID NO: 636 - protein, 6 aa, Artificial Sequence
  synthetic
QSISRN

SEQ ID NO: 637 - DNA, 9 bp, Artificial Sequence
  synthetic
ggtgcatcc

SEQ ID NO: 638 - protein, 3 aa, Artificial Sequence
  synthetic
GAS

SEQ ID NO: 639 - DNA, 27 bp, Artificial Sequence
  synthetic
cagcagtataataataggcctctcact

SEQ ID NO: 640 - protein, 9 aa, Artificial Sequence
  synthetic
QQYNNRPLT

SEQ ID NO: 641 - DNA, 354 bp, Artificial Sequence
  synthetic
caggtgcaattggtggagtctgggggaggcgtggtccagccggggaggtccctgagactctcctgtgctgcgtctggattcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagcagcctgagagccgaggacacggctgtatatttctgtgcgcgagggcctgggtacaattggctcgacccctggggccagggaaccctggtcaccgtctcctca

SEQ ID NO: 642 - protein, 118 aa, Artificial Sequence; identical to SEQ ID NO: 610
  synthetic

SEQ ID NO: 643 - DNA, 24 bp, Artificial Sequence
  synthetic
ggattcaccttcagaagttttggc

SEQ ID NO: 644 - protein, 8 aa, Artificial Sequence
  synthetic
GFTFRSFG

SEQ ID NO: 645 - DNA, 24 bp, Artificial Sequence
  synthetic
atatattttgatggaaaaaataaa

SEQ ID NO: 646 - protein, 8 aa, Artificial Sequence
  synthetic
IYFDGKNK

SEQ ID NO: 647 - DNA, 33 bp, Artificial Sequence; identical to SEQ ID NO: 567
  synthetic

SEQ ID NO: 648 - protein, 11 aa, Artificial Sequence
  synthetic
ARGPGYNWLDP

SEQ ID NO: 649 - DNA, 321 bp, Artificial Sequence
  synthetic
gaaatagtgatgacgcagtctccagccaccctgtctgtgtctccaggggaaagagccaccctctcctgtagggccagtcagagtgttagcaggaacttggcctggtaccagcaaaaacctggccaggctcccaggctcctcatctatggtgcatccaccagggccactggtgtcccagccaggttcagtggcagtgggtctgggacagagttcactctcaccatcagcagcctacagtctgaagattttgcagtttttcactgtcagcagtataataataggcctctcactttcggcggagggaccgaggtggagatcaaa

SEQ ID NO: 650 - protein, 107 aa, Artificial Sequence
  synthetic
EIVMTQSPATLSVSPGERATLSCRASQSVSRNLAWYQQKPGQAPRLLIYGASTRATGVPARFSGSGSGTEFTLTISSLQSEDFAVFHCQQYNNRPLTFGGGTEVEIK

SEQ ID NO: 651 - DNA, 18 bp, Artificial Sequence
  synthetic
cagagtgttagcaggaac

SEQ ID NO: 652 - protein, 6 aa, Artificial Sequence
  synthetic
QSVSRN

SEQ ID NO: 653 - DNA, 9 bp, Artificial Sequence
  synthetic
ggtgcatcc

SEQ ID NO: 654 - protein, 3 aa, Artificial Sequence
  synthetic
GAS

SEQ ID NO: 655 - DNA, 27 bp, Artificial Sequence
  synthetic
cagcagtataataataggcctctcact

SEQ ID NO: 656 - protein, 9 aa, Artificial Sequence
  synthetic
QQYNNRPLT

SEQ ID NO: 657 - DNA, 354 bp, Artificial Sequence; identical to SEQ ID NO: 641
  synthetic

SEQ ID NO: 658 - protein, 118 aa, Artificial Sequence; identical to SEQ ID NO: 610
  synthetic

SEQ ID NO: 659 - DNA, 24 bp, Artificial Sequence
  synthetic
ggattcaccttcagaagttttggc

SEQ ID NO: 660 - protein, 8 aa, Artificial Sequence
  synthetic
GFTFRSFG

SEQ ID NO: 661 - DNA, 24 bp, Artificial Sequence
  synthetic
atatattttgatggaaaaaataaa

SEQ ID NO: 662 - protein, 8 aa, Artificial Sequence
  synthetic
IYFDGKNK

SEQ ID NO: 663 - DNA, 33 bp, Artificial Sequence; identical to SEQ ID NO: 567
  synthetic

SEQ ID NO: 664 - protein, 11 aa, Artificial Sequence
  synthetic
ARGPGYNWLDP

SEQ ID NO: 665 - DNA, 321 bp, Artificial Sequence; identical to SEQ ID NO: 649
  synthetic

SEQ ID NO: 666 - protein, 107 aa, Artificial Sequence; identical to SEQ ID NO: 650
  synthetic

SEQ ID NO: 667 - DNA, 18 bp, Artificial Sequence
  synthetic
cagagtgttagcaggaac

SEQ ID NO: 668 - protein, 6 aa, Artificial Sequence
  synthetic
QSVSRN

SEQ ID NO: 669 - DNA, 9 bp, Artificial Sequence
  synthetic
ggtgcatcc

SEQ ID NO: 670 - protein, 3 aa, Artificial Sequence
  synthetic
GAS

SEQ ID NO: 671 - DNA, 27 bp, Artificial Sequence
  synthetic
cagcagtataataataggcctctcact

SEQ ID NO: 672 - protein, 9 aa, Artificial Sequence
  synthetic
QQYNNRPLT

SEQ ID NO: 673 - DNA, 354 bp, Artificial Sequence
  synthetic
caggtgcagttggtggagtctgggggaggcgtggtccagcctgggaggtccctgagactctcctgtgttgcgtctggattcaccttcagaagttatggcatgcactgggtccgccaggctccaggcaagggactgcagtgggtggcaatgatttactatgatggtaagaataaatattatgcagactccgtgaggggccgattcaccatctccagagacaattccaagaacacgctgtatctgcaaatgaacagtctgagagccgaagacacggctatgtatttctgtgcgcgagggcctgggtacaactggctcgacccctggggccagggaaccctggtcactgtctcctca

SEQ ID NO: 674 - protein, 118 aa, Artificial Sequence
  synthetic
QVQLVESGGGVVQPGRSLRLSCVASGFTFRSYGMHWVRQAPGKGLQWVAMIYYDGKNKYYADSVRGRFTISRDNSKNTLYLQMNSLRAEDTAMYFCARGPGYNWLDPWGQGTLVTVSS

SEQ ID NO: 675 - DNA, 24 bp, Artificial Sequence
  synthetic
ggattcaccttcagaagttatggc

SEQ ID NO: 676 - protein, 8 aa, Artificial Sequence
  synthetic
GFTFRSYG

SEQ ID NO: 677 - DNA, 24 bp, Artificial Sequence
  synthetic
atttactatgatggtaagaataaa

SEQ ID NO: 678 - protein, 8 aa, Artificial Sequence
  synthetic
IYYDGKNK

SEQ ID NO: 679 - DNA, 33 bp, Artificial Sequence; identical to SEQ ID NO: 551
  synthetic

SEQ ID NO: 680 - protein, 11 aa, Artificial Sequence
  synthetic
ARGPGYNWLDP

SEQ ID NO: 681 - DNA, 321 bp, Artificial Sequence
  synthetic
gaaatagtgatgacgcagtctccagccaccctgtctgtgtctccaggggaaagagccaccctctcctgcagggccagtcagagaattagcagcaacttggcctggtaccagcaaaaacctggccaggctcccaggctcctcatctatggtgcatccaccagggccactggtagcccagccaggttcagtggcagtgggtctgggacagagttcactctcaccatcagcagcctgcagtctgaagatgttgcagtttattactgtcagcaacataataactggcctctcactttcggcggagggaccaaggtggagatcaaa

SEQ ID NO: 682 - protein, 107 aa, Artificial Sequence
  synthetic
EIVMTQSPATLSVSPGERATLSCRASQRISSNLAWYQQKPGQAPRLLIYGASTRATGSPARFSGSGSGTEFTLTISSLQSEDVAVYYCQQHNNWPLTFGGGTKVEIK

SEQ ID NO: 683 - DNA, 18 bp, Artificial Sequence
  synthetic
cagagaattagcagcaac

SEQ ID NO: 684 - protein, 6 aa, Artificial Sequence
  synthetic
QRISSN

SEQ ID NO: 685 - DNA, 9 bp, Artificial Sequence
  synthetic
ggtgcatcc

SEQ ID NO: 686 - protein, 3 aa, Artificial Sequence
  synthetic
GAS

SEQ ID NO: 687 - DNA, 27 bp, Artificial Sequence
  synthetic
cagcaacataataactggcctctcact

SEQ ID NO: 688 - protein, 9 aa, Artificial Sequence
  synthetic
QQHNNWPLT

SEQ ID NO: 689 - DNA, 354 bp, Artificial Sequence
  synthetic
caggtgcaattggtggagtctgggggaggcgtggtccagccggggaggtccctgagactctcctgtgctgcgtctggtttcaccttcagaagttttggcatgcactgggtccgccaggctccaggcaggggactggagtgggtggcaatgatatattttgatggaaaaaataaatactatgcagactccgtgaggggccgattcaccatttccagagacaattccaagaacaccctgtatctggaaatgagtagcctgagagccgaggacacggctgtatatttctgtgcgcgagggcctgggtacaactggctcgacccctggggccagggaaccctggtcaccgtctcctca

SEQ ID NO: 690 - protein, 118 aa, Artificial Sequence; identical to SEQ ID NO: 610
  synthetic

SEQ ID NO: 691 - DNA, 24 bp, Artificial Sequence
  synthetic
ggtttcaccttcagaagttttggc

SEQ ID NO: 692 - protein, 8 aa, Artificial Sequence
  synthetic
GFTFRSFG

SEQ ID NO: 693 - DNA, 24 bp, Artificial Sequence
  synthetic
atatattttgatggaaaaaataaa

SEQ ID NO: 694 - protein, 8 aa, Artificial Sequence
  synthetic
IYFDGKNK

SEQ ID NO: 695 - DNA, 33 bp, Artificial Sequence; identical to SEQ ID NO: 551
  synthetic

SEQ ID NO: 696 - protein, 11 aa, Artificial Sequence
  synthetic
ARGPGYNWLDP

SEQ ID NO: 697 - DNA, 321 bp, Artificial Sequence
  synthetic
gaaatagtgatgacgcagtctccagccaccctgtctgtgtctccaggggaaagagtcatcctctcctgtagggccagtcagagtattagcaggaacttggcctggtaccagcaaaaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 698 - protein, 107 aa, Artificial Sequence
  synthetic
EIVMTQSPATLSVSPGERVILSCRASQSISRNLAWYQQKPGQAPRLLIYGATTRATGVPARFSGSGSGTEFTLTISSLQSEDFAVFYCQQYNNRPLTFGGGTEVEIK

SEQ ID NO: 699 - DNA, 18 bp, Artificial Sequence
  synthetic
cagagtattagcaggaac

SEQ ID NO: 700 - protein, 6 aa, Artificial Sequence
  synthetic
QSISRN

SEQ ID NO: 701 - DNA, 9 bp, Artificial Sequence
  synthetic
ggtgcaacc

SEQ ID NO: 702 - protein, 3 aa, Artificial Sequence
  synthetic
GAT

SEQ ID NO: 703 - DNA, 27 bp, Artificial Sequence
  synthetic
cagcagtataataataggcctctcact

SEQ ID NO: 704 - protein, 9 aa, Artificial Sequence
  synthetic
QQYNNRPLT

SEQ ID NO: 705 - DNA, 354 bp, Artificial Sequence; identical to SEQ ID NO: 689
  synthetic

SEQ ID NO: 706 - protein, 118 aa, Artificial Sequence; identical to SEQ ID NO: 610
  synthetic

SEQ ID NO: 707 - DNA, 24 bp, Artificial Sequence
  synthetic
ggtttcaccttcagaagttttggc

SEQ ID NO: 708 - protein, 8 aa, Artificial Sequence
  synthetic
GFTFRSFG

SEQ ID NO: 709 - DNA, 24 bp, Artificial Sequence
  synthetic
atatattttgatggaaaaaataaa

SEQ ID NO: 710 - protein, 8 aa, Artificial Sequence
  synthetic
IYFDGKNK

SEQ ID NO: 711 - DNA, 33 bp, Artificial Sequence; identical to SEQ ID NO: 551
  synthetic

SEQ ID NO: 712 - protein, 11 aa, Artificial Sequence
  synthetic
ARGPGYNWLDP

SEQ ID NO: 713 - DNA, 321 bp, Artificial Sequence
  synthetic
gaaatagtgatgacgcagtctccagccaccctgtctgtgtctccaggggaaagagtcatcctctcctgtagggccagtcagagtattagcaggaacttggcctggtaccagcaraaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 714 - protein, 107 aa, Artificial Sequence
  synthetic
  VARIANT (38)..(38): Xaa = Any Amino Acid
EIVMTQSPATLSVSPGERVILSCRASQSISRNLAWYQXKPGQAPRLLIYGATTRATGVPARFSGSGSGTEFTLTISSLQSEDFAVFYCQQYNNRPLTFGGGTEVEIK

SEQ ID NO: 715 - DNA, 18 bp, Artificial Sequence
  synthetic
cagagtattagcaggaac

SEQ ID NO: 716 - protein, 6 aa, Artificial Sequence
  synthetic
QSISRN

SEQ ID NO: 717 - DNA, 9 bp, Artificial Sequence
  synthetic
ggtgcaacc

SEQ ID NO: 718 - protein, 3 aa, Artificial Sequence
  synthetic
GAT

SEQ ID NO: 719 - DNA, 27 bp, Artificial Sequence
  synthetic
cagcagtataataataggcctctcact

SEQ ID NO: 720 - protein, 9 aa, Artificial Sequence
  synthetic
QQYNNRPLT

SEQ ID NO: 721 - DNA, 354 bp, Artificial Sequence; identical to SEQ ID NO: 593
  synthetic

SEQ ID NO: 722 - protein, 118 aa, Artificial Sequence; identical to SEQ ID NO: 594
  synthetic

SEQ ID NO: 723 - DNA, 24 bp, Artificial Sequence
  synthetic
ggatttaccttcagaagttatggc

SEQ ID NO: 724 - protein, 8 aa, Artificial Sequence
  synthetic
GFTFRSYG

SEQ ID NO: 725 - DNA, 24 bp, Artificial Sequence
  synthetic
atatattatgatggaaacaataaa

SEQ ID NO: 726 - protein, 8 aa, Artificial Sequence
  synthetic
IYYDGNNK

SEQ ID NO: 727 - DNA, 33 bp, Artificial Sequence; identical to SEQ ID NO: 551
  synthetic

SEQ ID NO: 728 - protein, 11 aa, Artificial Sequence
  synthetic
ARGPGYNWLDP

SEQ ID NO: 729 - DNA, 321 bp, Artificial Sequence; identical to SEQ ID NO: 601
  synthetic

SEQ ID NO: 730 - protein, 107 aa, Artificial Sequence; identical to SEQ ID NO: 602
  synthetic

SEQ ID NO: 731 - DNA, 18 bp, Artificial Sequence
  synthetic
cagagtgttagcagcaac

SEQ ID NO: 732 - protein, 6 aa, Artificial Sequence
  synthetic
QSVSSN

SEQ ID NO: 733 - DNA, 9 bp, Artificial Sequence
  synthetic
ggtgcatcc

SEQ ID NO: 734 - protein, 3 aa, Artificial Sequence
  synthetic
GAS

SEQ ID NO: 735 - DNA, 27 bp, Artificial Sequence
  synthetic
cagcagtataataacaggcctctcact

SEQ ID NO: 736 - protein, 9 aa, Artificial Sequence
  synthetic
QQYNNRPLT

SEQ ID NO: 737 - DNA, 372 bp, Artificial Sequence
  synthetic
gaagtgcagctggtggagtctgggggaggcttggtacagcctggcaggtccctgagactctcctgtgcagcctctggattcacctttgatgattattccatgcactgggtccggcaagctccagggaagggcctggagtgggtctcaggtattagttggaatagtcgtagcatagactatgcggactctgtgaagggccgattcaccatctccagagacaacgccaagaactccctgtatctgcaaatgaacagtctgagagctgaggacacggccttgtattactgtgtaaaagataatagtggctatggccgctattactactacgggatggacgtctggggccaagggaccacggtctccgtctcctca

SEQ ID NO: 738 - protein, 124 aa, Artificial Sequence
  synthetic
EVQLVESGGGLVQPGRSLRLSCAASGFTFDDYSMHWVRQAPGKGLEWVSGISWNSRSIDYADSVKGRFTISRDNAKNSLYLQMNSLRAEDTALYYCVKDNSGYGRYYYYGMDVWGQGTTVSVSS

SEQ ID NO: 739 - DNA, 24 bp, Artificial Sequence
  synthetic
ggattcacctttgatgattattcc

SEQ ID NO: 740 - protein, 8 aa, Artificial Sequence
  synthetic
GFTFDDYS

SEQ ID NO: 741 - DNA, 24 bp, Artificial Sequence
  synthetic
attagttggaatagtcgtagcata

SEQ ID NO: 742 - protein, 8 aa, Artificial Sequence
  synthetic
ISWNSRSI

SEQ ID NO: 743 - DNA, 51 bp, Artificial Sequence
  synthetic
gtaaaagataatagtggctatggccgctattactactacgggatggacgtc

SEQ ID NO: 744 - protein, 17 aa, Artificial Sequence
  synthetic
VKDNSGYGRYYYYGMDV

SEQ ID NO: 745 - DNA, 321 bp, Artificial Sequence
  synthetic
aaaatagtgatgacgcagtctcccgccaccctgtctgtgtctccaggggaaagagccaccctctcctgcagggccagtcagagtgttagcggcaacttagcctggtaccagcaaaaacctggccaggctcccaggctcctcatctatggtgcatccaccagggccactagtatcccagccaggttcagtggcagtgggtctgggacagagttcactctcaccatcagcagcctgcagtctgaagattttgcagtttatttctgtcagcactattataactggcctctcactttcggcggagggaccaaggtggagatcaga

SEQ ID NO: 746 - protein, 107 aa, Artificial Sequence
  synthetic
KIVMTQSPATLSVSPGERATLSCRASQSVSGNLAWYQQKPGQAPRLLIYGASTRATSIPARFSGSGSGTEFTLTISSLQSEDFAVYFCQHYYNWPLTFGGGTKVEIR

SEQ ID NO: 747 - DNA, 18 bp, Artificial Sequence
  synthetic
cagagtgttagcggcaac

SEQ ID NO: 748 - protein, 6 aa, Artificial Sequence
  synthetic
QSVSGN

SEQ ID NO: 749 - DNA, 9 bp, Artificial Sequence
  synthetic
ggtgcatcc

SEQ ID NO: 750 - protein, 3 aa, Artificial Sequence
  synthetic
GAS

SEQ ID NO: 751 - DNA, 27 bp, Artificial Sequence
  synthetic
cagcactattataactggcctctcact

SEQ ID NO: 752 - protein, 9 aa, Artificial Sequence
  synthetic
QHYYNWPLT

SEQ ID NO: 753 - DNA, 369 bp, Artificial Sequence; identical to SEQ ID NO: 401
  synthetic

SEQ ID NO: 754 - protein, 123 aa, Artificial Sequence; identical to SEQ ID NO: 402
  synthetic

SEQ ID NO: 755 - DNA, 24 bp, Artificial Sequence
  synthetic
ggattcacctttgatgattttacc

SEQ ID NO: 756 - protein, 8 aa, Artificial Sequence
  synthetic
GFTFDDFT

SEQ ID NO: 757 - DNA, 24 bp, Artificial Sequence
  synthetic
atcagttggaatagtggtagcata

SEQ ID NO: 758 - protein, 8 aa, Artificial Sequence
  synthetic
ISWNSGSI

SEQ ID NO: 759 - DNA, 48 bp, Artificial Sequence; identical to SEQ ID NO: 407
  synthetic

SEQ ID NO: 760 - protein, 16 aa, Artificial Sequence
  synthetic
AKDNSGYGYYYYGMDV

SEQ ID NO: 761 - DNA, 339 bp, Artificial Sequence
  synthetic
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaagctggagatcaaa

SEQ ID NO: 762 - protein, 113 aa, Artificial Sequence
  synthetic
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKLEIK

SEQ ID NO: 763 - DNA, 36 bp, Artificial Sequence
  synthetic
cagagtgttttatacagctccaacaataagaactac

SEQ ID NO: 764 - protein, 12 aa, Artificial Sequence
  synthetic
QSVLYSSNNKNY

SEQ ID NO: 765 - DNA, 9 bp, Artificial Sequence
  synthetic
tgggcatct

SEQ ID NO: 766 - protein, 3 aa, Artificial Sequence
  synthetic
WAS

SEQ ID NO: 767 - DNA, 27 bp, Artificial Sequence
  synthetic
cagcaatattatagtactccgtacact

SEQ ID NO: 768 - protein, 9 aa, Artificial Sequence
  synthetic
QQYYSTPYT

SEQ ID NO: 769 - DNA, 369 bp, Artificial Sequence
  synthetic
caggtcaccttgaaggagtctggtcctgcgctggtgaaacccacacagaccctcacactgacctgcaccttctctgggttctcactcagcactagtggaatgtgtgtgagctggatccgtcagcccccagggaaggccctggagtggcttgcacgcattgattgggatgatgataaatactacagcacatctctgaagaccaggctcaccatctccaaggacacctccaaaaaccaggtggtccttacaatgaccaacatggaccctgtggacacagccacgtattactgtgcacggatggatatagtgggagctagaggggggtggttcgacccctggggccagggaaccctggtcaccgtctcctca

SEQ ID NO: 770 - protein, 123 aa, Artificial Sequence
  synthetic
QVTLKESGPALVKPTQTLTLTCTFSGFSLSTSGMCVSWIRQPPGKALEWLARIDWDDDKYYSTSLKTRLTISKDTSKNQVVLTMTNMDPVDTATYYCARMDIVGARGGWFDPWGQGTLVTVSS

SEQ ID NO: 771 - DNA, 30 bp, Artificial Sequence
  synthetic
gggttctcactcagcactagtggaatgtgt

SEQ ID NO: 772 - protein, 10 aa, Artificial Sequence
  synthetic
GFSLSTSGMC

SEQ ID NO: 773 - DNA, 21 bp, Artificial Sequence
  synthetic
attgattgggatgatgataaa

SEQ ID NO: 774 - protein, 7 aa, Artificial Sequence
  synthetic
IDWDDDK

SEQ ID NO: 775 - DNA, 45 bp, Artificial Sequence
  synthetic
gcacggatggatatagtgggagctagaggggggtggttcgacccc

SEQ ID NO: 776 - protein, 15 aa, Artificial Sequence
  synthetic
ARMDIVGARGGWFDP

SEQ ID NO: 777 - DNA, 321 bp, Artificial Sequence
  synthetic
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccgctcactttcggcggagggaccaaggtggagatcaaa

SEQ ID NO: 778 - protein, 107 aa, Artificial Sequence
  synthetic
DIQMTQSPSSLSASVGDRVTITCRASQGISNYLAWFQQKPGKAPKSLIYAASSLQSGVPSKFSGSGSGTDFTLTISSLQPEDFATYYCQQYNSYPLTFGGGTKVEIK

SEQ ID NO: 779 - DNA, 18 bp, Artificial Sequence
  synthetic
cagggcattagcaattat

SEQ ID NO: 780 - protein, 6 aa, Artificial Sequence
  synthetic
QGISNY

SEQ ID NO: 781 - DNA, 9 bp, Artificial Sequence
  synthetic
gctgcatcc

SEQ ID NO: 782 - protein, 3 aa, Artificial Sequence
  synthetic
AAS

SEQ ID NO: 783 - DNA, 27 bp, Artificial Sequence
  synthetic
caacagtataatagttacccgctcact

SEQ ID NO: 784 - protein, 9 aa, Artificial Sequence
  synthetic
QQYNSYPLT

SEQ ID NO: 785 - DNA, 404 bp, Artificial Sequence
  synthetic
caggtgcagttggtggagtctgggggaggcgtggtccagcctgggaggtccctgagactctcctgtgctgcgtctggattcaccttcagaagttatggcatgcactgggtccgccaggctccaggcaaggggctggagtgggtggcaatgatatattatgatggaaataataaaaagtatgcagactccgtgaggggccgattcaccatttccagagacaattccaagaacacgctgtatctgcaaatgaacagcctgagagtcgaggacacggctgtgtatttctgtgcgcgagggcctgggtacaactggctcgacccctggggccagggaaccctggtcaccgtctcctcagccaaaacaacagccccacccgtttatccactggcccctggaagcttggg

SEQ ID NO: 786 - protein, 134 aa, Artificial Sequence
  synthetic
QVQLVESGGGVVQPGRSLRLSCAASGFTFRSYGMHWVRQAPGKGLEWVAMIYYDGNNKKYADSVRGRFTISRDNSKNTLYLQMNSLRVEDTAVYFCARGPGYNWLDPWGQGTLVTVSSAKTTAPPVYPLAPGSL

SEQ ID NO: 787 - DNA, 24 bp, Artificial Sequence
  synthetic
ggattcaccttcagaagttatggc

SEQ ID NO: 788 - protein, 8 aa, Artificial Sequence
  synthetic
GFTFRSYG

SEQ ID NO: 789 - DNA, 24 bp, Artificial Sequence
  synthetic
atatattatgatggaaataataaa

SEQ ID NO: 790 - protein, 8 aa, Artificial Sequence
  synthetic
IYYDGNNK

SEQ ID NO: 791 - DNA, 33 bp, Artificial Sequence; identical to SEQ ID NO: 551
  synthetic

SEQ ID NO: 792 - protein, 11 aa, Artificial Sequence
  synthetic
ARGPGYNWLDP

SEQ ID NO: 793 - DNA, 321 bp, Artificial Sequence
  synthetic
gaaatagtgatgacgcagtctccagccaccctgtctgtgtctccaggggaaagagccaccctctcctgcagggccagtcagagtgttagcaggaacttggcctggtaccagcagaaacctggccaggctcccaggctcctcatctatggtgcatccaccagggccactgatatcccagccaggttcagtggcagtgggtctgggacagagttcattctcaacatcagcagcctgcagtctgaagattttgcactttattactgtcaacaatatagtaactggcctctcactttcggcggagggaccgaggtggagatcaaa

SEQ ID NO: 794 - protein, 107 aa, Artificial Sequence
  synthetic
EIVMTQSPATLSVSPGERATLSCRASQSVSRNLAWYQQKPGQAPRLLIYGASTRATDIPARFSGSGSGTEFILNISSLQSEDFALYYCQQYSNWPLTFGGGTEVEIK

SEQ ID NO: 795 - DNA, 18 bp, Artificial Sequence
  synthetic
cagagtgttagcaggaac

SEQ ID NO: 796 - protein, 6 aa, Artificial Sequence
  synthetic
QSVSRN

SEQ ID NO: 797 - DNA, 9 bp, Artificial Sequence
  synthetic
ggtgcatcc

SEQ ID NO: 798 - protein, 3 aa, Artificial Sequence
  synthetic
GAS

SEQ ID NO: 799 - DNA, 27 bp, Artificial Sequence
  synthetic
caacaatatagtaactggcctctcact

SEQ ID NO: 800 - protein, 9 aa, Artificial Sequence
  synthetic
QQYSNWPLT

SEQ ID NO: 801 - DNA, 354 bp, Artificial Sequence; identical to SEQ ID NO: 689
  synthetic

SEQ ID NO: 802 - protein, 118 aa, Artificial Sequence; identical to SEQ ID NO: 610
  synthetic

SEQ ID NO: 803 - DNA, 24 bp, Artificial Sequence
  synthetic
ggtttcaccttcagaagttttggc

SEQ ID NO: 804 - protein, 8 aa, Artificial Sequence
  synthetic
GFTFRSFG

SEQ ID NO: 805 - DNA, 24 bp, Artificial Sequence
  synthetic
atatattttgatggaaaaaataaa

SEQ ID NO: 806 - protein, 8 aa, Artificial Sequence
  synthetic
IYFDGKNK

SEQ ID NO: 807 - DNA, 33 bp, Artificial Sequence; identical to SEQ ID NO: 551
  synthetic

SEQ ID NO: 808 - protein, 11 aa, Artificial Sequence
  synthetic
ARGPGYNWLDP

SEQ ID NO: 809 - DNA, 321 bp, Artificial Sequence
  synthetic
gaaatagtgatgacgcagtctccagccaccctgtctgtgtctccaggggaaagagtcatcctctcctgtagggccagtcagagtattagcaggaacttggcctggtaccagcagaaacctggccaggctcccaggctcctcatctatggtgcaaccaccagggccactggtgtcccagccaggttcagtggcagtgggtctgggacagagttcactctcaccatcagcagcctacagtctgaagattttgcagttttttactgtcagcagtataataataggcctctcactttcggcggagggaccgaggtggagatcaaa

SEQ ID NO: 810 - protein, 107 aa, Artificial Sequence; identical to SEQ ID NO: 698
  synthetic

SEQ ID NO: 811 - DNA, 18 bp, Artificial Sequence
  synthetic
cagagtattagcaggaac

SEQ ID NO: 812 - protein, 6 aa, Artificial Sequence
  synthetic
QSISRN

SEQ ID NO: 813 - DNA, 9 bp, Artificial Sequence
  synthetic
ggtgcaacc

SEQ ID NO: 814 - protein, 3 aa, Artificial Sequence
  synthetic
GAT

SEQ ID NO: 815 - DNA, 27 bp, Artificial Sequence
  synthetic
cagcagtataataataggcctctcact

SEQ ID NO: 816 - protein, 9 aa, Artificial Sequence
  synthetic
QQYNNRPLT

SEQ ID NO: 817 - DNA, 354 bp, Artificial Sequence; identical to SEQ ID NO: 689
  synthetic

SEQ ID NO: 818 - protein, 118 aa, Artificial Sequence; identical to SEQ ID NO: 610
  synthetic

SEQ ID NO: 819 - DNA, 24 bp, Artificial Sequence
  synthetic
ggtttcaccttcagaagttttggc

SEQ ID NO: 820 - protein, 8 aa, Artificial Sequence
  synthetic
GFTFRSFG

SEQ ID NO: 821 - DNA, 24 bp, Artificial Sequence
  synthetic
atatattttgatggaaaaaataaa

SEQ ID NO: 822 - protein, 8 aa, Artificial Sequence
  synthetic
IYFDGKNK

SEQ ID NO: 823 - DNA, 33 bp, Artificial Sequence; identical to SEQ ID NO: 551
  synthetic

SEQ ID NO: 824 - protein, 11 aa, Artificial Sequence
  synthetic
ARGPGYNWLDP

SEQ ID NO: 825 - DNA, 321 bp, Artificial Sequence; identical to SEQ ID NO: 809
  synthetic

SEQ ID NO: 826 - protein, 107 aa, Artificial Sequence; identical to SEQ ID NO: 698
  synthetic

SEQ ID NO: 827 - DNA, 18 bp, Artificial Sequence
  synthetic
cagagtattagcaggaac

SEQ ID NO: 828 - protein, 6 aa, Artificial Sequence
  synthetic
QSISRN

SEQ ID NO: 829 - DNA, 9 bp, Artificial Sequence
  synthetic
ggtgcaacc

SEQ ID NO: 830 - protein, 3 aa, Artificial Sequence
  synthetic
GAT

SEQ ID NO: 831 - DNA, 27 bp, Artificial Sequence
  synthetic
cagcagtataataataggcctctcact

SEQ ID NO: 832 - protein, 9 aa, Artificial Sequence
  synthetic
QQYNNRPLT

SEQ ID NO: 833 - DNA, 351 bp, Artificial Sequence
  synthetic
caggtgcacctggaagagtctgggggaggcgtggtccagcctgggaggtccctgagactctcctgttcagcgtctggtttcaccttcagtagttatgccatgcactgggtccgccaggctccaggcaaggggctggagtgggtggcagttatatggtatgatggaactaataaatattatttagattccgtgaagggccgattcaccatctccagagacaattccaagaacacgctgtttctgcaaatgaacagcctgagagccgaagacacggctgtgtattactgtgcgagagatcggggaagtataataacccactggggccagggaaccctggtcaccgtctcctca

SEQ ID NO: 834 - protein, 117 aa, Artificial Sequence
  synthetic
QVHLEESGGGVVQPGRSLRLSCSASGFTFSSYAMHWVRQAPGKGLEWVAVIWYDGTNKYYLDSVKGRFTISRDNSKNTLFLQMNSLRAEDTAVYYCARDRGSIITHWGQGTLVTVSS

SEQ ID NO: 835 - DNA, 24 bp, Artificial Sequence
  synthetic
ggtttcaccttcagtagttatgcc

SEQ ID NO: 836 - protein, 8 aa, Artificial Sequence
  synthetic
GFTFSSYA

SEQ ID NO: 837 - DNA, 24 bp, Artificial Sequence
  synthetic
atatggtatgatggaactaataaa

SEQ ID NO: 838 - protein, 8 aa, Artificial Sequence
  synthetic
IWYDGTNK

SEQ ID NO: 839 - DNA, 30 bp, Artificial Sequence
  synthetic
gcgagagatcggggaagtataataacccac

SEQ ID NO: 840 - protein, 10 aa, Artificial Sequence
  synthetic
ARDRGSIITH

SEQ ID NO: 841 - DNA, 324 bp, Artificial Sequence
  synthetic
gacatccagatgacccagtctccatcctccctgtctgcatctataggagacagagtcaccatcacttgccgggcaagtcagaacattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagacttacagtacccctccgatcaccttcggccaagggacacgactggagattaaa

SEQ ID NO: 842 - protein, 108 aa, Artificial Sequence
  synthetic
DIQMTQSPSSLSASIGDRVTITCRASQNISSYLNWYQQKPGKAPKLLIYAASSLQSGVPSRFSGSGSGTDFTLTISSLQPEDFATYYCQQTYSTPPITFGQGTRLEIK

SEQ ID NO: 843 - DNA, 18 bp, Artificial Sequence
  synthetic
cagaacattagcagctat

SEQ ID NO: 844 - protein, 6 aa, Artificial Sequence
  synthetic
QNISSY

SEQ ID NO: 845 - DNA, 9 bp, Artificial Sequence
  synthetic
gctgcatcc

SEQ ID NO: 846 - protein, 3 aa, Artificial Sequence
  synthetic
AAS

SEQ ID NO: 847 - DNA, 30 bp, Artificial Sequence
  synthetic
caacagacttacagtacccctccgatcacc

SEQ ID NO: 848 - protein, 10 aa, Artificial Sequence
  synthetic
QQTYSTPPIT

SEQ ID NO: 849 - DNA, 372 bp, Artificial Sequence
  synthetic
gaagtacagctggtggagtctgggggaggcttggtacggcctggcaggtccctgagactctcctgtgcagcctctggattcacctttgatgattataccatgcactgggtccgccaagctccagggaagggcctggagtgggtctcagatattagttggaatagtgggaccataggctatgcggactctgtgaagggccgattcaccatctccagagacaacgccaagaactccctgtatctgcaaatgaacagtctgagacctgaggacacggccttgtattactgtgcaaaagatatgagtggctacgcccactactactactacggtatggacgtctggggccaagggaccacggtcaccgtctcctca

SEQ ID NO: 850 - protein, 124 aa, Artificial Sequence
  synthetic
EVQLVESGGGLVRPGRSLRLSCAASGFTFDDYTMHWVRQAPGKGLEWVSDISWNSGTIGYADSVKGRFTISRDNAKNSLYLQMNSLRPEDTALYYCAKDMSGYAHYYYYGMDVWGQGTTVTVSS

SEQ ID NO: 851 - DNA, 24 bp, Artificial Sequence
  synthetic
ggattcacctttgatgattatacc

SEQ ID NO: 852 - protein, 8 aa, Artificial Sequence
  synthetic
GFTFDDYT

SEQ ID NO: 853 - DNA, 24 bp, Artificial Sequence
  synthetic
attagttggaatagtgggaccata

SEQ ID NO: 854 - protein, 8 aa, Artificial Sequence
  synthetic
ISWNSGTI

SEQ ID NO: 855 - DNA, 51 bp, Artificial Sequence
  synthetic
gcaaaagatatgagtggctacgcccactactactactacggtatggacgtc

SEQ ID NO: 856 - protein, 17 aa, Artificial Sequence
  synthetic
AKDMSGYAHYYYYGMDV

SEQ ID NO: 857 - DNA, 324 bp, Artificial Sequence
  synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 858 - protein, 108 aa, Artificial Sequence; identical to SEQ ID NO: 394
  synthetic

SEQ ID NO: 859 - DNA, 18 bp, Artificial Sequence
  synthetic
cagagcattagcagctat

SEQ ID NO: 860 - protein, 6 aa, Artificial Sequence
  synthetic
QSISSY

SEQ ID NO: 861 - DNA, 9 bp, Artificial Sequence
  synthetic
gctgcatcc

SEQ ID NO: 862 - protein, 3 aa, Artificial Sequence
  synthetic
AAS

SEQ ID NO: 863 - DNA, 30 bp, Artificial Sequence; identical to SEQ ID NO: 31
  synthetic

SEQ ID NO: 864 - protein, 10 aa, Artificial Sequence
  synthetic
QQSYSTPPIT

SEQ ID NO: 865 - DNA, 372 bp, Artificial Sequence
  synthetic
gaagtgcagctggtggagtctgggggaggcttggtacagcctggcaggtccctgagactctcctgtgcagcctctggattcacctttgatgattataccatgcactgggtccggcaagctccagggaagggcctggagtgggtctccgatattagttggaatagtggtagcataggctatgcggactctgtgaagggccgattcaccgtctccagagacaacgccaagaactccctgtatctgcaaatgaacagtctgagaggtgaggacacggccctgtattactgtgcaaaagatatgagtggctacgcccactacggctactacggtatggacgtctggggccaagggaccacggtcaccgtctcctca

SEQ ID NO: 866 - protein, 124 aa, Artificial Sequence
  synthetic
EVQLVESGGGLVQPGRSLRLSCAASGFTFDDYTMHWVRQAPGKGLEWVSDISWNSGSIGYADSVKGRFTVSRDNAKNSLYLQMNSLRGEDTALYYCAKDMSGYAHYGYYGMDVWGQGTTVTVSS

SEQ ID NO: 867 - DNA, 24 bp, Artificial Sequence
  synthetic
ggattcacctttgatgattatacc

SEQ ID NO: 868 - protein, 8 aa, Artificial Sequence
  synthetic
GFTFDDYT

SEQ ID NO: 869 - DNA, 24 bp, Artificial Sequence
  synthetic
attagttggaatagtggtagcata

SEQ ID NO: 870 - protein, 8 aa, Artificial Sequence
  synthetic
ISWNSGSI

SEQ ID NO: 871 - DNA, 51 bp, Artificial Sequence
  synthetic
gcaaaagatatgagtggctacgcccactacggctactacggtatggacgtc

SEQ ID NO: 872 - protein, 17 aa, Artificial Sequence
  synthetic
AKDMSGYAHYGYYGMDV

SEQ ID NO: 873 - DNA, 324 bp, Artificial Sequence
  synthetic
gacatccagatgacccagtctccatcctccctgtctgcatctgtaggagacagagtcaccatcacttgccgggcaagtcagagcattaggaactatttaaattggtatcagcagaaaccagggaaagtccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaaccctccgatcaccttcggccaagggacacgactggagattaaa

SEQ ID NO: 874 - protein, 108 aa, Artificial Sequence
  synthetic
DIQMTQSPSSLSASVGDRVTITCRASQSIRNYLNWYQQKPGKVPKLLIYAASSLQSGVPSRFSGSGSGTDFTLTISSLQPEDFATYYCQQSYSNPPITFGQGTRLEIK

SEQ ID NO: 875 - DNA, 18 bp, Artificial Sequence
  synthetic
cagagcattaggaactat

SEQ ID NO: 876 - protein, 6 aa, Artificial Sequence
  synthetic
QSIRNY

SEQ ID NO: 877 - DNA, 9 bp, Artificial Sequence
  synthetic
gctgcatcc

SEQ ID NO: 878 - protein, 3 aa, Artificial Sequence
  synthetic
AAS

SEQ ID NO: 879 - DNA, 30 bp, Artificial Sequence
  synthetic
caacagagttacagtaaccctccgatcacc

SEQ ID NO: 880 - protein, 10 aa, Artificial Sequence
  synthetic
QQSYSNPPIT

SEQ ID NO: 881 - DNA, 369 bp, Artificial Sequence
  synthetic
gaagcgcagctggtggaatctgggggaggcttggtacagcctggcaggtccctgagactctcctgtacaacctctggattcacctttgatgattataccatgcactgggtccggcaagctccagggaagggcctggagtggatctctgatattagttggaatggtggaaccaaaggctatgcggactctgtgaagggccgattcaccatctccagagacaacgccaaaaactccctgtatctgcaaatggacagtctgagaggtgaggacacggccttatattactgtgtaaaagataaaagtggctacgggcacttctacttcggtttggacgtctggggccaagggaccacggtcaccgtctcctca

SEQ ID NO: 882 - protein, 123 aa, Artificial Sequence
  synthetic
EAQLVESGGGLVQPGRSLRLSCTTSGFTFDDYTMHWVRQAPGKGLEWISDISWNGGTKGYADSVKGRFTISRDNAKNSLYLQMDSLRGEDTALYYCVKDKSGYGHFYFGLDVWGQGTTVTVSS

SEQ ID NO: 883 - DNA, 24 bp, Artificial Sequence
  synthetic
ggattcacctttgatgattatacc

SEQ ID NO: 884 - protein, 8 aa, Artificial Sequence
  synthetic
GFTFDDYT

SEQ ID NO: 885 - DNA, 24 bp, Artificial Sequence
  synthetic
attagttggaatggtggaaccaaa

SEQ ID NO: 886 - protein, 8 aa, Artificial Sequence
  synthetic
ISWNGGTK

SEQ ID NO: 887 - DNA, 48 bp, Artificial Sequence
  synthetic
gtaaaagataaaagtggctacgggcacttctacttcggtttggacgtc

SEQ ID NO: 888 - protein, 16 aa, Artificial Sequence
  synthetic
VKDKSGYGHFYFGLDV

SEQ ID NO: 889 - DNA, 324 bp, Artificial Sequence
  synthetic
gacatccagatgacccagtctccatcctccctgactgcgtctgtaggagacagagtcaccttcacttgccgggcaagtcagagcattagcaggcatttaagttggtatcagcagaaaccagggaaagcccctaagctcctgatctatgctgcatccagtttggaaagtggggtcccttcaaggttcagtggcagtggatctgggacagatttcactctcaccatcagcagtctgcaccctgaagattttgcaacttactactgtcaacagagctacagtaaccctccgatcaccttcggccaagggacacgactggagattaaa

SEQ ID NO: 890 - protein, 108 aa, Artificial Sequence
  synthetic
DIQMTQSPSSLTASVGDRVTFTCRASQSISRHLSWYQQKPGKAPKLLIYAASSLESGVPSRFSGSGSGTDFTLTISSLHPEDFATYYCQQSYSNPPITFGQGTRLEIK

SEQ ID NO: 891 - DNA, 18 bp, Artificial Sequence
  synthetic
cagagcattagcaggcat

SEQ ID NO: 892 - protein, 6 aa, Artificial Sequence
  synthetic
QSISRH

SEQ ID NO: 893 - DNA, 9 bp, Artificial Sequence
  synthetic
gctgcatcc

SEQ ID NO: 894 - protein, 3 aa, Artificial Sequence
  synthetic
AAS

SEQ ID NO: 895 - DNA, 30 bp, Artificial Sequence
  synthetic
caacagagctacagtaaccctccgatcacc

SEQ ID NO: 896 - protein, 10 aa, Artificial Sequence
  synthetic
QQSYSNPPIT

SEQ ID NO: 897 - DNA, 369 bp, Artificial Sequence
  synthetic
gaagtgcagttggtggagtctgggggaggcttggtacagcctggcaggtccctgagactctcctgtgcagcctctggattcaagtttgctgattatgccatgcactgggtccggcaagctccagggaagggcctggagtgggtctcagagattagttggaatagtggtagcataggttatgtggactctgtgaagggccgattcaccatctccagagacaacgccaagaactccctgtatctgcaaatgaacagtctgagagctgaggacacggccttgtattactgtgtaaaagataaaagtggctacgggcactactatatcggtatggacgtctggggccaagggaccacggtcatcgtctcctcc

SEQ ID NO: 898 - protein, 123 aa, Artificial Sequence
  synthetic
EVQLVESGGGLVQPGRSLRLSCAASGFKFADYAMHWVRQAPGKGLEWVSEISWNSGSIGYVDSVKGRFTISRDNAKNSLYLQMNSLRAEDTALYYCVKDKSGYGHYYIGMDVWGQGTTVIVSS

SEQ ID NO: 899 - DNA, 24 bp, Artificial Sequence
  synthetic
ggattcaagtttgctgattatgcc

SEQ ID NO: 900 - protein, 8 aa, Artificial Sequence
  synthetic
GFKFADYA

SEQ ID NO: 901 - DNA, 24 bp, Artificial Sequence
  synthetic
attagttggaatagtggtagcata

SEQ ID NO: 902 - protein, 8 aa, Artificial Sequence
  synthetic
ISWNSGSI

SEQ ID NO: 903 - DNA, 48 bp, Artificial Sequence
  synthetic
gtaaaagataaaagtggctacgggcactactatatcggtatggacgtc

SEQ ID NO: 904 - protein, 16 aa, Artificial Sequence
  synthetic
VKDKSGYGHYYIGMDV

SEQ ID NO: 905 - DNA, 324 bp, Artificial Sequence
  synthetic
gacatccagatgacccagtctccatcctccctgtctgcatctgtaggagacagagtcaccatcacttgccgggcaagtcagagtattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 906 - protein, 108 aa, Artificial Sequence; identical to SEQ ID NO: 394
  synthetic

SEQ ID NO: 907 - DNA, 18 bp, Artificial Sequence
  synthetic
cagagtattagcagctat

SEQ ID NO: 908 - protein, 6 aa, Artificial Sequence
  synthetic
QSISSY

SEQ ID NO: 909 - DNA, 9 bp, Artificial Sequence
  synthetic
gctgcatcc

SEQ ID NO: 910 - protein, 3 aa, Artificial Sequence
  synthetic
AAS

SEQ ID NO: 911 - DNA, 30 bp, Artificial Sequence; identical to SEQ ID NO: 31
  synthetic

SEQ ID NO: 912 - protein, 10 aa, Artificial Sequence
  synthetic
QQSYSTPPIT

SEQ ID NO: 913 - DNA, 372 bp, Artificial Sequence
  synthetic
gaagtgcacctggtggagtctgggggaggcttggtacagcctggcaggtccctgagactctcctgtgcagcctctggattcacctttgatgattataccatgcactgggtccggcaagctccagggaagggcctggagtgggtctccgatattagttggaatagtggtagcataggctatgcggactctgtgaagggccgattcaccgtctccagagacaacgccaagaactccctgtatctgcaaatgaacagtctgagaggtgaggacacggccttgtattactgtgcaaaagatatgagtggctacggccactacggcaagtacggtatggacgtctggggccaagggaccacggtcaccgtctcctca

SEQ ID NO: 914 - protein, 124 aa, Artificial Sequence
  synthetic
EVHLVESGGGLVQPGRSLRLSCAASGFTFDDYTMHWVRQAPGKGLEWVSDISWNSGSIGYADSVKGRFTVSRDNAKNSLYLQMNSLRGEDTALYYCAKDMSGYGHYGKYGMDVWGQGTTVTVSS

SEQ ID NO: 915 - DNA, 24 bp, Artificial Sequence
  synthetic
ggattcacctttgatgattatacc

SEQ ID NO: 916 - protein, 8 aa, Artificial Sequence
  synthetic
GFTFDDYT

SEQ ID NO: 917 - DNA, 24 bp, Artificial Sequence
  synthetic
attagttggaatagtggtagcata

SEQ ID NO: 918 - protein, 8 aa, Artificial Sequence
  synthetic
ISWNSGSI

SEQ ID NO: 919 - DNA, 51 bp, Artificial Sequence
  synthetic
gcaaaagatatgagtggctacggccactacggcaagtacggtatggacgtc

SEQ ID NO: 920 - protein, 17 aa, Artificial Sequence
  synthetic
AKDMSGYGHYGKYGMDV

SEQ ID NO: 921 - DNA, 324 bp, Artificial Sequence
  synthetic
gacatccagatgacccagtctccatcctccctgtctgcatctgtaggagacagagtcaccatcacttgccgggcaagtcagagcattaggagctatttaaattggtatcagcagaaaccagggaaagtccctaagctcctgatctatgctgcatccagtttgcaaagtggggtcccatcaaggttcagtggcagtggatctgggacagatttcactctcaccatcaacagtctgcaacctgacgattttgcaacttactactgtcaacagacttacagtaaccctccgatcaccttcggccaagggacacgactggagattaaa

SEQ ID NO: 922 - protein, 108 aa, Artificial Sequence
  synthetic
DIQMTQSPSSLSASVGDRVTITCRASQSIRSYLNWYQQKPGKVPKLLIYAASSLQSGVPSRFSGSGSGTDFTLTINSLQPDDFATYYCQQTYSNPPITFGQGTRLEIK

SEQ ID NO: 923 - DNA, 18 bp, Artificial Sequence
  synthetic
cagagcattaggagctat

SEQ ID NO: 924 - protein, 6 aa, Artificial Sequence
  synthetic
QSIRSY

SEQ ID NO: 925 - DNA, 9 bp, Artificial Sequence
  synthetic
gctgcatcc

SEQ ID NO: 926 - protein, 3 aa, Artificial Sequence
  synthetic
AAS

SEQ ID NO: 927 - DNA, 30 bp, Artificial Sequence
  synthetic
caacagacttacagtaaccctccgatcacc

SEQ ID NO: 928 - protein, 10 aa, Artificial Sequence
  synthetic
QQTYSNPPIT

SEQ ID NO: 929 - DNA, 372 bp, Artificial Sequence
  synthetic
gaggtgcagctggtggagtctgggggagacttggtacagcctggcaggtccctgagactctcctgtgcagcctctggattcacctttgatgattataccatgcactgggtccggcaagctccagggaagggcctggagtgggtctcaattattagttggaatggtaataccattgactatgcggactctgtgaagggccgattcaccatctccagagacaacgccaagaactccctgtatcttcaaatgaacagtctgagagctgaggacacggccttgtattactgtgcaaaagataagagtggctacggacacttctactattacgttttggacgtctggggccaagggaccacggtcaccgtctcctca

SEQ ID NO: 930 - protein, 124 aa, Artificial Sequence
  synthetic
EVQLVESGGDLVQPGRSLRLSCAASGFTFDDYTMHWVRQAPGKGLEWVSIISWNGNTIDYADSVKGRFTISRDNAKNSLYLQMNSLRAEDTALYYCAKDKSGYGHFYYYVLDVWGQGTTVTVSS

SEQ ID NO: 931 - DNA, 24 bp, Artificial Sequence
  synthetic
ggattcacctttgatgattatacc

SEQ ID NO: 932 - protein, 8 aa, Artificial Sequence
  synthetic
GFTFDDYT

SEQ ID NO: 933 - DNA, 24 bp, Artificial Sequence
  synthetic
attagttggaatggtaataccatt

SEQ ID NO: 934 - protein, 8 aa, Artificial Sequence
  synthetic
ISWNGNTI

SEQ ID NO: 935 - DNA, 51 bp, Artificial Sequence
  synthetic
gcaaaagataagagtggctacggacacttctactattacgttttggacgtc

SEQ ID NO: 936 - protein, 17 aa, Artificial Sequence
  synthetic
AKDKSGYGHFYYYVLDV

SEQ ID NO: 937 - DNA, 321 bp, Artificial Sequence
  synthetic
gacatccagatgacccagtctccatcctccctgtctgcatctgtaggagacagagtcaccatcacttgccgggcaagtcagagcattaacaactatttaaattggtatcagcagaaaccagggaaagcccctaaactcctgatctatgctgcttccagtttgcaaagtggggtcccgtcaaggttcagtggcagtggttctgggacagatttcactctcaccatcagcagtctgcaacctgaagattttgcaacttactactctcaacagagttacagtttcccgtggacgttcggccaagggaccaaggtggaaatcaaa

SEQ ID NO: 938 - protein, 107 aa, Artificial Sequence
  synthetic
DIQMTQSPSSLSASVGDRVTITCRASQSINNYLNWYQQKPGKAPKLLIYAASSLQSGVPSRFSGSGSGTDFTLTISSLQPEDFATYYSQQSYSFPWTFGQGTKVEIK

SEQ ID NO: 939 - DNA, 18 bp, Artificial Sequence
  synthetic
cagagcattaacaactat

SEQ ID NO: 940 - protein, 6 aa, Artificial Sequence
  synthetic
QSINNY

SEQ ID NO: 941 - DNA, 9 bp, Artificial Sequence
  synthetic
gctgcttcc

SEQ ID NO: 942 - protein, 3 aa, Artificial Sequence
  synthetic
AAS

SEQ ID NO: 943 - DNA, 27 bp, Artificial Sequence
  synthetic
caacagagttacagtttcccgtggacg

SEQ ID NO: 944 - protein, 9 aa, Artificial Sequence
  synthetic
QQSYSFPWT

SEQ ID NO: 945 - DNA, 363 bp, Artificial Sequence
  synthetic
caggtgcagctggtggagtcggggggaggcgtggtccagcctgggaggtccctgagaccctcctgtgcagcgtctggatttagtttcagggactatggcatgcactgggtccgccaggctccaggtaagggactagagtggatggcacacatatggtataatggaaagaataaatattatgcagactccgtgaagggccgattcaccatctccagagacaattccaagaacacgctatatctgcaaatgaacagcctgagacccgaggacacggctgtatattattgtgcgagagatggtgtatcagcacgtggtactccatttgactactggggccagggaaccctggtcaccgtctcctca

SEQ ID NO: 946 - protein, 121 aa, Artificial Sequence
  synthetic
QVQLVESGGGVVQPGRSLRPSCAASGFSFRDYGMHWVRQAPGKGLEWMAHIWYNGKNKYYADSVKGRFTISRDNSKNTLYLQMNSLRPEDTAVYYCARDGVSARGTPFDYWGQGTLVTVSS

SEQ ID NO: 947 - DNA, 24 bp, Artificial Sequence
  synthetic
ggatttagtttcagggactatggc

SEQ ID NO: 948 - protein, 8 aa, Artificial Sequence
  synthetic
GFSFRDYG

SEQ ID NO: 949 - DNA, 24 bp, Artificial Sequence
  synthetic
atatggtataatggaaagaataaa

SEQ ID NO: 950 - protein, 8 aa, Artificial Sequence
  synthetic
IWYNGKNK

SEQ ID NO: 951 - DNA, 42 bp, Artificial Sequence
  synthetic
gcgagagatggtgtatcagcacgtggtactccatttgactac

SEQ ID NO: 952 - protein, 14 aa, Artificial Sequence
  synthetic
ARDGVSARGTPFDY

SEQ ID NO: 953 - DNA, 321 bp, Artificial Sequence
  synthetic
gaaacgacactcacgcagtctccagcattcatgtcagcggctccaggagacaaagtcagcatctcctgcattgccagccagtacattgatgatgatgtgaactggtaccaacagaaaccaggagaaactgctattttcattattcaagaagcttctactctcgttcctggaatctcacctcgattcagtggcagcgggtatggaacacattttaccctcacaattaataacatagattctgaggatgctgcattttacttctgtctccaacatgataatttcccgtacacttttggccaggggaccaagctggagatcaaa

SEQ ID NO: 954 - protein, 107 aa, Artificial Sequence
  synthetic
ETTLTQSPAFMSAAPGDKVSISCIASQYIDDDVNWYQQKPGETAIFIIQEASTLVPGISPRFSGSGYGTHFTLTINNIDSEDAAFYFCLQHDNFPYTFGQGTKLEIK

SEQ ID NO: 955 - DNA, 18 bp, Artificial Sequence
  synthetic
cagtacattgatgatgat

SEQ ID NO: 956 - protein, 6 aa, Artificial Sequence
  synthetic
QYIDDD

SEQ ID NO: 957 - DNA, 9 bp, Artificial Sequence
  synthetic
gaagcttct

SEQ ID NO: 958 - protein, 3 aa, Artificial Sequence
  synthetic
EAS

SEQ ID NO: 959 - DNA, 27 bp, Artificial Sequence
  synthetic
ctccaacatgataatttcccgtacact

SEQ ID NO: 960 - protein, 9 aa, Artificial Sequence
  synthetic
LQHDNFPYT

SEQ ID NO: 961 - DNA, 384 bp, Artificial Sequence
  synthetic
caggtgcagctggtggagtctgggggaggcttggtacagcctggggggtccctgagactctcctgtgcagcctcttatttcacctttagcagttttgccatgaactgggtccgccaggctccagggcagggcctggagtgggtctcagctattagtggtagggtctcagctattagtggtagtggtggtatcacatactacgcagactccgtgaagggccggttcatcatctccagagacaattccaagaacacgctgtatctgcaaatgagcggcctgagagccgaggacacggccgtatattactgtgcgaaaggcccctatttgactacagtcaccccctttgactactggggccagggaaccctggtcaccgtctcctca

SEQ ID NO: 962 - protein, 128 aa, Artificial Sequence
  synthetic
QVQLVESGGGLVQPGGSLRLSCAASYFTFSSFAMNWVRQAPGQGLEWVSAISGRVSAISGSGGITYYADSVKGRFIISRDNSKNTLYLQMSGLRAEDTAVYYCAKGPYLTTVTPFDYWGQGTLVTVSS

SEQ ID NO: 963 - DNA, 24 bp, Artificial Sequence
  synthetic
tatttcacctttagcagttttgcc

SEQ ID NO: 964 - protein, 8 aa, Artificial Sequence
  synthetic
YFTFSSFA

SEQ ID NO: 965 - DNA, 24 bp, Artificial Sequence
  synthetic
attagtggtagtggtggtatcaca

SEQ ID NO: 966 - protein, 8 aa, Artificial Sequence
  synthetic
ISGSGGIT

SEQ ID NO: 967 - DNA, 42 bp, Artificial Sequence
  synthetic
gcgaaaggcccctatttgactacagtcaccccctttgactac

SEQ ID NO: 968 - protein, 14 aa, Artificial Sequence
  synthetic
AKGPYLTTVTPFDY

SEQ ID NO: 969 - DNA, 324 bp, Artificial Sequence
  synthetic
gacatccagttgacccagtctccatcttccgtgtctgcatctgtcggagacagagtcaccatcacttgtcgggcgagtcaggggattagcagctggttagcctggtatcagcagaaaccagggaaagcccctaaactcctgatctatgctgtatccagtttgcaaaatggggtcccatcaaggttcagcggcagtggatctgggacagatttcaccctcaccatcagcagcctgcagcctgaagactttgcaacttactattgtcaacaggctaacagtttcccattcactttcggccctgggaccaagctggagatcaaacga

SEQ ID NO: 970 - protein, 108 aa, Artificial Sequence
  synthetic
DIQLTQSPSSVSASVGDRVTITCRASQGISSWLAWYQQKPGKAPKLLIYAVSSLQNGVPSRFSGSGSGTDFTLTISSLQPEDFATYYCQQANSFPFTFGPGTKLEIKR

SEQ ID NO: 971 - DNA, 18 bp, Artificial Sequence
  synthetic
caggggattagcagctgg

SEQ ID NO: 972 - protein, 6 aa, Artificial Sequence
  synthetic
QGISSW

SEQ ID NO: 973 - DNA, 9 bp, Artificial Sequence
  synthetic
gctgtatcc

SEQ ID NO: 974 - protein, 3 aa, Artificial Sequence
  synthetic
AVS

SEQ ID NO: 975 - DNA, 27 bp, Artificial Sequence
  synthetic
caacaggctaacagtttcccattcact

SEQ ID NO: 976 - protein, 9 aa, Artificial Sequence
  synthetic
QQANSFPFT

SEQ ID NO: 977 - DNA, 369 bp, Artificial Sequence
  synthetic
gaggtgcagctggtggagtctgggggaggcttggtacagcctggcaggtccctgagactctcctgtgcagcctctggattcacctttgctgattatgccatgcactgggtccggcaagctccagggaagggcctggagtgggtctcaggtattagttggaatagtggtagtataggttatgcggactctgtgaagggccgattcaccatctccagagacaacgccaagaactccctgtatctgcaaatgaacagtctgagagctgaggacacggccttatattactgtgtaaaagataatagtggctacgcatcctactactacggtatggacgtctggggccaagggaccacggtcaccgtctcctca

SEQ ID NO: 978 - protein, 123 aa, Artificial Sequence
  synthetic
EVQLVESGGGLVQPGRSLRLSCAASGFTFADYAMHWVRQAPGKGLEWVSGISWNSGSIGYADSVKGRFTISRDNAKNSLYLQMNSLRAEDTALYYCVKDNSGYASYYYGMDVWGQGTTVTVSS

SEQ ID NO: 979 - DNA, 24 bp, Artificial Sequence
  synthetic
ggattcacctttgctgattatgcc

SEQ ID NO: 980 - protein, 8 aa, Artificial Sequence
  synthetic
GFTFADYA

SEQ ID NO: 981 - DNA, 24 bp, Artificial Sequence
  synthetic
attagttggaatagtggtagtata

SEQ ID NO: 982 - protein, 8 aa, Artificial Sequence
  synthetic
ISWNSGSI

SEQ ID NO: 983 - DNA, 48 bp, Artificial Sequence
  synthetic
gtaaaagataatagtggctacgcatcctactactacggtatggacgtc

SEQ ID NO: 984 - protein, 16 aa, Artificial Sequence
  synthetic
VKDNSGYASYYYGMDV

SEQ ID NO: 985 - DNA, 324 bp, Artificial Sequence
  synthetic
gacatccagttgacccagtccccatcctccctgtctgcatctgtaggagacagagtcaccatcacttgccgggcaagtcagagcattagcagctatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccattcactttcggccctgggaccaaagtggatatcaaacga

SEQ ID NO: 986 - protein, 108 aa, Artificial Sequence
  synthetic
DIQLTQSPSSLSASVGDRVTITCRASQSISSYLNWYQQKPGKAPKLLIYDASNLETGVPSRFSGSGSGTDFTFTISSLQPEDIATYYCQQYDNLPFTFGPGTKVDIKR

SEQ ID NO: 987 - DNA, 18 bp, Artificial Sequence
  synthetic
cagagcattagcagctat

SEQ ID NO: 988 - protein, 6 aa, Artificial Sequence
  synthetic
QSISSY

SEQ ID NO: 989 - DNA, 9 bp, Artificial Sequence
  synthetic
gatgcatcc

SEQ ID NO: 990 - protein, 3 aa, Artificial Sequence
  synthetic
DAS

SEQ ID NO: 991 - DNA, 27 bp, Artificial Sequence
  synthetic
caacagtatgataatctcccattcact

SEQ ID NO: 992 - protein, 9 aa, Artificial Sequence
  synthetic
QQYDNLPFT

SEQ ID NO: 993 - DNA, 378 bp, Artificial Sequence
  synthetic
gaggtgcagctggtggagtctgggggaggcgtggtccagcctgggaggtccctgagactctcctgtgcagcctctggattcaccttcagtaactatggcatgcactgggtccgccaggctccaggcaaagggctggagtgggtgacagttatattacatgatggaagttataaatactatgcagactccgtgaagggccgattcaccatctccagagacaattccaagaacacgctacatctgcaaatgaacagcctgagaactgaggacacggctgtatattactgtgcgaaagggcctatgtttcggggagtcccttacaaccactactatggtatggacgtctggggccaagggaccacggtcaccgtctcctca

SEQ ID NO: 994 - protein, 126 aa, Artificial Sequence
  synthetic
EVQLVESGGGVVQPGRSLRLSCAASGFTFSNYGMHWVRQAPGKGLEWVTVILHDGSYKYYADSVKGRFTISRDNSKNTLHLQMNSLRTEDTAVYYCAKGPMFRGVPYNHYYGMDVWGQGTTVTVSS

SEQ ID NO: 995 - DNA, 24 bp, Artificial Sequence
  synthetic
ggattcaccttcagtaactatggc

SEQ ID NO: 996 - protein, 8 aa, Artificial Sequence
  synthetic
GFTFSNYG

SEQ ID NO: 997 - DNA, 24 bp, Artificial Sequence
  synthetic
atattacatgatggaagttataaa

SEQ ID NO: 998 - protein, 8 aa, Artificial Sequence
  synthetic
ILHDGSYK

SEQ ID NO: 999 - DNA, 57 bp, Artificial Sequence
  synthetic
gcgaaagggcctatgtttcggggagtcccttacaaccactactatggtatggacgtc

SEQ ID NO: 1000 - protein, 19 aa, Artificial Sequence
  synthetic
AKGPMFRGVPYNHYYGMDV

SEQ ID NO: 1001 - DNA, 324 bp, Artificial Sequence
  synthetic
gacatccagatgacccagtctccatcctccctgtctgcatctgtaggagacagagtcaccatcacttgccgggcaagtcagggcatcagaaatgatttaggctggtatcagcagaaaccagggaaagcccctaagcgcctgatctatgctgcatccagtttgcaaagtggggtctcatcaaggttcagcggcagtggatctgggacagaattcactctcacaatcagcagcctgcagcctgaagattttgcaacttattactgtctacagcataatagttacccgtacacttttggccaggggaccaaggtggaaatcaaacga

SEQ ID NO: 1002 - protein, 108 aa, Artificial Sequence
  synthetic
DIQMTQSPSSLSASVGDRVTITCRASQGIRNDLGWYQQKPGKAPKRLIYAASSLQSGVSSRFSGSGSGTEFTLTISSLQPEDFATYYCLQHNSYPYTFGQGTKVEIKR

SEQ ID NO: 1003 - DNA, 18 bp, Artificial Sequence
  synthetic
cagggcatcagaaatgat

SEQ ID NO: 1004 - protein, 6 aa, Artificial Sequence
  synthetic
QGIRND

SEQ ID NO: 1005 - DNA, 9 bp, Artificial Sequence
  synthetic
gctgcatcc

SEQ ID NO: 1006 - protein, 3 aa, Artificial Sequence
  synthetic
AAS

SEQ ID NO: 1007 - DNA, 27 bp, Artificial Sequence
  synthetic
ctacagcataatagttacccgtacact

SEQ ID NO: 1008 - protein, 9 aa, Artificial Sequence
  synthetic
LQHNSYPYT

SEQ ID NO: 1009 - DNA, 357 bp, Artificial Sequence
  synthetic
gaggtgcagctggtggagtctgggggaggcgtggtccagcctgggaggtccctgagactctcctgtacagcgtcaggtttccccttcagtcgctatggcatgcactgggtccgccaggctccaggcaaggggctggaatgggtgacatttatatggtatgatggaagtaataaatactatgcagactccgcgaagggccgattcaccatcaccagagacaattccaagaacacggtgtatctgcaaatggacagcctgagagccgatgacacggctgtttattattgtgtgagagatcaggcagctctctactattttgactcttggggccagggaaccctggtcaccgtctcctca

SEQ ID NO: 1010 - protein, 119 aa, Artificial Sequence
  synthetic
EVQLVESGGGVVQPGRSLRLSCTASGFPFSRYGMHWVRQAPGKGLEWVTFIWYDGSNKYYADSAKGRFTITRDNSKNTVYLQMDSLRADDTAVYYCVRDQAALYYFDSWGQGTLVTVSS

SEQ ID NO: 1011 - DNA, 24 bp, Artificial Sequence
  synthetic
ggtttccccttcagtcgctatggc

SEQ ID NO: 1012 - protein, 8 aa, Artificial Sequence
  synthetic
GFPFSRYG

SEQ ID NO: 1013 - DNA, 24 bp, Artificial Sequence
  synthetic
atatggtatgatggaagtaataaa

SEQ ID NO: 1014 - protein, 8 aa, Artificial Sequence
  synthetic
IWYDGSNK

SEQ ID NO: 1015 - DNA, 36 bp, Artificial Sequence
  synthetic
gtgagagatcaggcagctctctactattttgactct

SEQ ID NO: 1016 - protein, 12 aa, Artificial Sequence
  synthetic
VRDQAALYYFDS

SEQ ID NO: 1017 - DNA, 324 bp, Artificial Sequence
  synthetic
gacatccagatgacccagtctccatcttccgtgtctgcatctgtaggagacagagtcaccatcacttgtcgggcgagtcagggtattagcaggtggttagcctggtatcagcagaaaccagggaaagcccctaagctcctgatctctgctgcatccagtttgcaaagtggagtcccatcaaggttcagcggcagtggatctgggacagatttcactctcaccatcagcggcctgcagcctgaagattttgcaacttactattgtcaaaaggctaacagtttccctttcactttcggccctgggaccaagctggagatcaaacga

SEQ ID NO: 1018 - protein, 108 aa, Artificial Sequence
  synthetic
DIQMTQSPSSVSASVGDRVTITCRASQGISRWLAWYQQKPGKAPKLLISAASSLQSGVPSRFSGSGSGTDFTLTISGLQPEDFATYYCQKANSFPFTFGPGTKLEIKR

SEQ ID NO: 1019 - DNA, 18 bp, Artificial Sequence
  synthetic
cagggtattagcaggtgg

SEQ ID NO: 1020 - protein, 6 aa, Artificial Sequence
  synthetic
QGISRW

SEQ ID NO: 1021 - DNA, 9 bp, Artificial Sequence
  synthetic
gctgcatcc

SEQ ID NO: 1022 - protein, 3 aa, Artificial Sequence
  synthetic
AAS

SEQ ID NO: 1023 - DNA, 27 bp, Artificial Sequence
  synthetic
caaaaggctaacagtttccctttcact

SEQ ID NO: 1024 - protein, 9 aa, Artificial Sequence
  synthetic
QKANSFPFT

SEQ ID NO: 1025 - DNA, 378 bp, Artificial Sequence
  synthetic
gaggtgcagctggtggagtctgggggaggcgtggtccagcctgggaggtccctgagactctcctgtgcagcctctggattcaccttcagtagttatggcatgcactgggtccgccaggctccaggcaaggggctggagtgggtgacagttatattacatgatggaagtaatagatactctgcagactccgtgaagggccgattcaccatctccagagacaattccaagaacacgctttatctgcaaatgaacatcctgagagttgaggacacggctgtgtattactgtacgaaaggggctatggttcggggagtcccttacaatcactactacggcatggacgtctggggccaagggaccacggtcaccgtctcctca

SEQ ID NO: 1026 - protein, 126 aa, Artificial Sequence
  synthetic
EVQLVESGGGVVQPGRSLRLSCAASGFTFSSYGMHWVRQAPGKGLEWVTVILHDGSNRYSADSVKGRFTISRDNSKNTLYLQMNILRVEDTAVYYCTKGAMVRGVPYNHYYGMDVWGQGTTVTVSS

SEQ ID NO: 1027 - DNA, 24 bp, Artificial Sequence
  synthetic
ggattcaccttcagtagttatggc

SEQ ID NO: 1028 - protein, 8 aa, Artificial Sequence
  synthetic
GFTFSSYG

SEQ ID NO: 1029 - DNA, 24 bp, Artificial Sequence
  synthetic
atattacatgatggaagtaataga

SEQ ID NO: 1030 - protein, 8 aa, Artificial Sequence
  synthetic
ILHDGSNR

SEQ ID NO: 1031 - DNA, 57 bp, Artificial Sequence
  synthetic
acgaaaggggctatggttcggggagtcccttacaatcactactacggcatggacgtc

SEQ ID NO: 1032 - protein, 19 aa, Artificial Sequence
  synthetic
TKGAMVRGVPYNHYYGMDV

SEQ ID NO: 1033 - DNA, 324 bp, Artificial Sequence
  synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctaatctatgctgcatccattttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaacga

SEQ ID NO: 1034 - protein, 108 aa, Artificial Sequence
  synthetic
DIQMTQSPSSLSASVGDRVTITCRASQGIRNDLGWYQQKPGKAPKRLIYAASILQSGVPSRFSGSGSGTEFTLTISSLQPEDFATYYCLQHNSYPYTFGQGTKLEIKR

SEQ ID NO: 1035 - DNA, 18 bp, Artificial Sequence
  synthetic
cagggcattagaaatgat

SEQ ID NO: 1036 - protein, 6 aa, Artificial Sequence
  synthetic
QGIRND

SEQ ID NO: 1037 - DNA, 9 bp, Artificial Sequence
  synthetic
gctgcatcc

SEQ ID NO: 1038 - protein, 3 aa, Artificial Sequence
  synthetic
AAS

SEQ ID NO: 1039 - DNA, 27 bp, Artificial Sequence
  synthetic
ctacagcataatagttacccgtacact

SEQ ID NO: 1040 - protein, 9 aa, Artificial Sequence
  synthetic
LQHNSYPYT

SEQ ID NO: 1041 - DNA, 378 bp, Artificial Sequence
  synthetic
gaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgacagttatattacatgatggaagtaatagatactatgcagactccgtgaagggccgattcaccatctccagagacaattccaagaacacgctttatctgcaaatgaacatcctgagagctgaggacacggctgtgtattactgtacgaaaggggctatggttcggggagtcccttacaatcactactacggcatggacgtctggggccaagggaccacggtcaccgtctcctca

SEQ ID NO: 1042 - protein, 126 aa, Artificial Sequence
  synthetic
EVQLVESGGGVVQPGRSLRLSCAASGFTFSSYGMHWVRQAPGKGLEWVTVILHDGSNRYYADSVKGRFTISRDNSKNTLYLQMNILRAEDTAVYYCTKGAMVRGVPYNHYYGMDVWGQGTTVTVSS

SEQ ID NO: 1043 - DNA, 24 bp, Artificial Sequence
  synthetic
ggattcaccttcagtagctatggc

SEQ ID NO: 1044 - protein, 8 aa, Artificial Sequence
  synthetic
GFTFSSYG

SEQ ID NO: 1045 - DNA, 24 bp, Artificial Sequence
  synthetic
atattacatgatggaagtaataga

SEQ ID NO: 1046 - protein, 8 aa, Artificial Sequence
  synthetic
ILHDGSNR

SEQ ID NO: 1047 - DNA, 57 bp, Artificial Sequence; identical to SEQ ID NO: 1031
  synthetic

SEQ ID NO: 1048 - protein, 19 aa, Artificial Sequence
  synthetic
TKGAMVRGVPYNHYYGMDV

SEQ ID NO: 1049 - DNA, 324 bp, Artificial Sequence
  synthetic
gacatcgtgatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccaatttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaacga

SEQ ID NO: 1050 - protein, 108 aa, Artificial Sequence
  synthetic
DIVMTQSPSSLSASVGDRVTITCRASQGIRNDLGWYQQKPGKAPKRLIYAASNLQSGVPSRFSGSGSGTEFTLTISSLQPEDFATYYCLQHNSYPYTFGQGTKLEIKR

SEQ ID NO: 1051 - DNA, 18 bp, Artificial Sequence
  synthetic
cagggcattagaaatgat

SEQ ID NO: 1052 - protein, 6 aa, Artificial Sequence
  synthetic
QGIRND

SEQ ID NO: 1053 - DNA, 9 bp, Artificial Sequence
  synthetic
gctgcatcc

SEQ ID NO: 1054 - protein, 3 aa, Artificial Sequence
  synthetic
AAS

SEQ ID NO: 1055 - DNA, 27 bp, Artificial Sequence
  synthetic
ctacagcataatagttacccgtacact

SEQ ID NO: 1056 - protein, 9 aa, Artificial Sequence
  synthetic
LQHNSYPYT

SEQ ID NO: 1057 - DNA, 378 bp, Artificial Sequence
  synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagactattccaagaacacgctgtatctgcaaatgaacagcctgagagctgaggacacggctgtgttttactgtgcgaaaggggctatggttcggggagtcccttacaactactactacggtatggacgtctggggccaagggaccacggtcaccgtctcctca

SEQ ID NO: 1058 - protein, 126 aa, Artificial Sequence
  synthetic
QVQLVESGGGVVQPGRSLRLSCAASGFTFSSYGMHWVRQAPGKGLEWVAVISYDGSNKYYADSVKGRFTISRDYSKNTLYLQMNSLRAEDTAVFYCAKGAMVRGVPYNYYYGMDVWGQGTTVTVSS

SEQ ID NO: 1059 - DNA, 24 bp, Artificial Sequence
  synthetic
ggattcaccttcagtagctatggc

SEQ ID NO: 1060 - protein, 8 aa, Artificial Sequence
  synthetic
GFTFSSYG

SEQ ID NO: 1061 - DNA, 24 bp, Artificial Sequence
  synthetic
atatcatatgatggaagtaataaa

SEQ ID NO: 1062 - protein, 8 aa, Artificial Sequence
  synthetic
ISYDGSNK

SEQ ID NO: 1063 - DNA, 57 bp, Artificial Sequence
  synthetic
gcgaaaggggctatggttcggggagtcccttacaactactactacggtatggacgtc

SEQ ID NO: 1064 - protein, 19 aa, Artificial Sequence
  synthetic
AKGAMVRGVPYNYYYGMDV

SEQ ID NO: 1065 - DNA, 321 bp, Artificial Sequence
  synthetic
gacatccagatgacccagtctccatcctccctgtctgcatctgtaggagacagagtcaccatcacttgccgggcaagtcagggcattagaaatgatttaggctggtttcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 1066 - protein, 107 aa, Artificial Sequence
  synthetic
DIQMTQSPSSLSASVGDRVTITCRASQGIRNDLGWFQQKPGKAPKRLIYAASSLQSGVPSRFSGSGSGTEFTLTISSLQPEDFATYYCLQHNSYPYTFGQGTKLEIK

SEQ ID NO: 1067 - DNA, 18 bp, Artificial Sequence
  synthetic
cagggcattagaaatgat

SEQ ID NO: 1068 - protein, 6 aa, Artificial Sequence
  synthetic
QGIRND

SEQ ID NO: 1069 - DNA, 9 bp, Artificial Sequence
  synthetic
gctgcatcc

SEQ ID NO: 1070 - protein, 3 aa, Artificial Sequence
  synthetic
AAS

SEQ ID NO: 1071 - DNA, 27 bp, Artificial Sequence
  synthetic
ctacagcataatagttacccgtacact

SEQ ID NO: 1072 - protein, 9 aa, Artificial Sequence
  synthetic
LQHNSYPYT

SEQ ID NO: 1073 - DNA, 378 bp, Artificial Sequence
  synthetic
caggtgcagctggtggagtctgggggaggcgtggtccagcctgggaggtccctgagactctcctgtgcagcctctggactcaccttcagtagctatggcatgcactgggtccgccaggctccaggcaaggggctggagtgggtggcagttatatcatatgatggaagtaataaatactatacagactccgtgaagggccgattcaccatctccagagacaattctaagaacacgctgtatctgcaaatgaacagcctgagagctgaggacacggctgtgtattactgtgcgaaaggggccatggttcggggagtcccttacaactactactacggtatggacgtctggggccaagggaccacggtcaccgtctcctca

SEQ ID NO: 1074 - protein, 126 aa, Artificial Sequence
  synthetic
QVQLVESGGGVVQPGRSLRLSCAASGLTFSSYGMHWVRQAPGKGLEWVAVISYDGSNKYYTDSVKGRFTISRDNSKNTLYLQMNSLRAEDTAVYYCAKGAMVRGVPYNYYYGMDVWGQGTTVTVSS

SEQ ID NO: 1075 - DNA, 24 bp, Artificial Sequence
  synthetic
ggactcaccttcagtagctatggc

SEQ ID NO: 1076 - protein, 8 aa, Artificial Sequence
  synthetic
GLTFSSYG

SEQ ID NO: 1077 - DNA, 24 bp, Artificial Sequence
  synthetic
atatcatatgatggaagtaataaa

SEQ ID NO: 1078 - protein, 8 aa, Artificial Sequence
  synthetic
ISYDGSNK

SEQ ID NO: 1079 - DNA, 57 bp, Artificial Sequence
  synthetic
gcgaaaggggccatggttcggggagtcccttacaactactactacggtatggacgtc

SEQ ID NO: 1080 - protein, 19 aa, Artificial Sequence
  synthetic
AKGAMVRGVPYNYYYGMDV

SEQ ID NO: 1081 - DNA, 321 bp, Artificial Sequence
  synthetic
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcgtccagtttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 1082 - protein, 107 aa, Artificial Sequence
  synthetic
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPYTFGQGTKLEIK

SEQ ID NO: 1083 - DNA, 18 bp, Artificial Sequence
  synthetic
cagggcattagaaatgat

SEQ ID NO: 1084 - protein, 6 aa, Artificial Sequence
  synthetic
QGIRND

SEQ ID NO: 1085 - DNA, 9 bp, Artificial Sequence
  synthetic
gctgcgtcc

SEQ ID NO: 1086 - protein, 3 aa, Artificial Sequence
  synthetic
AAS

SEQ ID NO: 1087 - DNA, 27 bp, Artificial Sequence
  synthetic
ctacagcataatagttacccgtacact

SEQ ID NO: 1088 - protein, 9 aa, Artificial Sequence
  synthetic
LQHNSYPYT

SEQ ID NO: 1089 - DNA, 378 bp, Artificial Sequence
  synthetic
caggtgcagctggtggagtctgggggaggcgtggtccagcctgggaggtccctgagactctcctgtgcagcctctggattcaccttcaggagctttggcatgcactgggtccgccaggctccaggcaaggggctggagtgggtggcagttatttcatatgatggaaattataaatactatgcagactccgtgaagggccgattcaccatctccagagacaattccaagaacacgctgtatctgcaaatgaacagcctgagagctgaggacacggctgtacattactgtgcgaaaggggctatggttcggggagtcccttacaacttctactacggtatggacgtctggggccaagggaccacggtcaccgtctcctca

SEQ ID NO: 1090 - protein, 126 aa, Artificial Sequence
  synthetic
QVQLVESGGGVVQPGRSLRLSCAASGFTFRSFGMHWVRQAPGKGLEWVAVISYDGNYKYYADSVKGRFTISRDNSKNTLYLQMNSLRAEDTAVHYCAKGAMVRGVPYNFYYGMDVWGQGTTVTVSS

SEQ ID NO: 1091 - DNA, 24 bp, Artificial Sequence
  synthetic
ggattcaccttcaggagctttggc

SEQ ID NO: 1092 - protein, 8 aa, Artificial Sequence
  synthetic
GFTFRSFG

SEQ ID NO: 1093 - DNA, 24 bp, Artificial Sequence
  synthetic
atttcatatgatggaaattataaa

SEQ ID NO: 1094 - protein, 8 aa, Artificial Sequence
  synthetic
ISYDGNYK

SEQ ID NO: 1095 - DNA, 57 bp, Artificial Sequence
  synthetic
gcgaaaggggctatggttcggggagtcccttacaacttctactacggtatggacgtc

SEQ ID NO: 1096 - protein, 19 aa, Artificial Sequence
  synthetic
AKGAMVRGVPYNFYYGMDV

SEQ ID NO: 1097 - DNA, 321 bp, Artificial Sequence
  synthetic
gacatccagatgacccagtctccatcctccctgtctgcatctgtaggagacagagtcaccatcacttgccgggcaagtcaggtcattagaaatgatttaggctggtatcagcagaaaccagggaaagcccctaagcgcctgatctatgctgcatccagtttgcaaagtgggatcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 1098 - protein, 107 aa, Artificial Sequence
  synthetic
DIQMTQSPSSLSASVGDRVTITCRASQVIRNDLGWYQQKPGKAPKRLIYAASSLQSGIPSRFSGSGSGTEFTLTISSLQPEDFATYYCLQHNSYPYTFGQGTKLEIK

SEQ ID NO: 1099 - DNA, 18 bp, Artificial Sequence
  synthetic
caggtcattagaaatgat

SEQ ID NO: 1100 - protein, 6 aa, Artificial Sequence
  synthetic
QVIRND

SEQ ID NO: 1101 - DNA, 9 bp, Artificial Sequence
  synthetic
gctgcatcc

SEQ ID NO: 1102 - protein, 3 aa, Artificial Sequence
  synthetic
AAS

SEQ ID NO: 1103 - DNA, 27 bp, Artificial Sequence
  synthetic
ctacagcataatagttacccgtacact

SEQ ID NO: 1104 - protein, 9 aa, Artificial Sequence
  synthetic
LQHNSYPYT

SEQ ID NO: 1105 - DNA, 369 bp, Artificial Sequence
  synthetic
gaggtgcagctggtggagtctgggggaggcttggtacagcctggcaggtccctgagactctcctgtgcagcctctggattcacctttgatgattataccatgcactgggtccggcaagttccaggaaagggcctggagtggatctcaggtattagttggaatagtggtagcatggactatgcggactctgtgaagggccgattcaccatctctagagacaacgccaggaactccctgtttctgcaaatgaacagtgtgagaactgaggacacggccttgtattactgtgcaaaagataagagtggctacggctccttctactacggtatggacgtctggggccaggggaccacggtcaccgtctcctca

SEQ ID NO: 1106 - protein, 123 aa, Artificial Sequence
  synthetic
EVQLVESGGGLVQPGRSLRLSCAASGFTFDDYTMHWVRQVPGKGLEWISGISWNSGSMDYADSVKGRFTISRDNARNSLFLQMNSVRTEDTALYYCAKDKSGYGSFYYGMDVWGQGTTVTVSS

SEQ ID NO: 1107 - DNA, 24 bp, Artificial Sequence
  synthetic
ggattcacctttgatgattatacc

SEQ ID NO: 1108 - protein, 8 aa, Artificial Sequence
  synthetic
GFTFDDYT

SEQ ID NO: 1109 - DNA, 24 bp, Artificial Sequence
  synthetic
attagttggaatagtggtagcatg

SEQ ID NO: 1110 - protein, 8 aa, Artificial Sequence
  synthetic
ISWNSGSM

SEQ ID NO: 1111 - DNA, 48 bp, Artificial Sequence
  synthetic
gcaaaagataagagtggctacggctccttctactacggtatggacgtc

SEQ ID NO: 1112 - protein, 16 aa, Artificial Sequence
  synthetic
AKDKSGYGSFYYGMDV

SEQ ID NO: 1113 - DNA, 324 bp, Artificial Sequence
  synthetic
gaaattgtgttgacgcagtctccaggcaccctgtctttgtctccaggggacagagccaccctctcctgcagggccagtcagagtgtcagcagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgctcactcaccgtacacttttggccaggggaccaagctggagatcaaa

SEQ ID NO: 1114 - protein, 108 aa, Artificial Sequence
  synthetic
EIVLTQSPGTLSLSPGDRATLSCRASQSVSSIYLAWYQQKPGQAPRLLIHGASTRATGIPDRFSGSGSGTDFTLTISRLEPEDFAVYYCQQRAHSPYTFGQGTKLEIK

SEQ ID NO: 1115 - DNA, 21 bp, Artificial Sequence
  synthetic
cagagtgtcagcagcatctac

SEQ ID NO: 1116 - protein, 7 aa, Artificial Sequence
  synthetic
QSVSSIY

SEQ ID NO: 1117 - DNA, 9 bp, Artificial Sequence
  synthetic
ggtgcgtcc

SEQ ID NO: 1118 - protein, 3 aa, Artificial Sequence
  synthetic
GAS

SEQ ID NO: 1119 - DNA, 27 bp, Artificial Sequence
  synthetic
cagcagcgtgctcactcaccgtacact

SEQ ID NO: 1120 - protein, 9 aa, Artificial Sequence
  synthetic
QQRAHSPYT

SEQ ID NO: 1121 - DNA, 369 bp, Artificial Sequence
  synthetic
gaagtgcagctggtggagtctgggggaggcttggtacagcctggcaggtccctgagactctcctgtgcagcctctggcttcagctttgataattatgccatgcactgggtccggcaagctccaggacagggcctggagtgggtctcaggtattagttggaatagtggtagcagagactatgcggactctgtgaagggccgattcaccatctccagagacaatgccaggaactccctgtttctgcaaatgaacagtctgagtaatgaggacacggccatgtattactgcgcaaaagataagagtggctacggctcctacttctacggtatggacgtctggggccaagggaccacggtcaccgtctcctca

SEQ ID NO: 1122 - protein, 123 aa, Artificial Sequence
  synthetic
EVQLVESGGGLVQPGRSLRLSCAASGFSFDNYAMHWVRQAPGQGLEWVSGISWNSGSRDYADSVKGRFTISRDNARNSLFLQMNSLSNEDTAMYYCAKDKSGYGSYFYGMDVWGQGTTVTVSS

SEQ ID NO: 1123 - DNA, 24 bp, Artificial Sequence
  synthetic
ggcttcagctttgataattatgcc

SEQ ID NO: 1124 - protein, 8 aa, Artificial Sequence
  synthetic
GFSFDNYA

SEQ ID NO: 1125 - DNA, 24 bp, Artificial Sequence
  synthetic
attagttggaatagtggtagcaga

SEQ ID NO: 1126 - protein, 8 aa, Artificial Sequence
  synthetic
ISWNSGSR

SEQ ID NO: 1127 - DNA, 48 bp, Artificial Sequence
  synthetic
gcaaaagataagagtggctacggctcctacttctacggtatggacgtc

SEQ ID NO: 1128 - protein, 16 aa, Artificial Sequence
  synthetic
AKDKSGYGSYFYGMDV

SEQ ID NO: 1129 - DNA, 324 bp, Artificial Sequence
  synthetic
gaaattgtgttgacgcagtctccaggcaccctgtctttgtctccaggggacagagccaccctctcctgcagggccagtcagagtattagaaacatctatttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagtttaccgtacacttttggccaggggaccaagctggagatcaaa

SEQ ID NO: 1130 - protein, 108 aa, Artificial Sequence
  synthetic
EIVLTQSPGTLSLSPGDRATLSCRASQSIRNIYLAWYQQKPGQAPRLLIHGASTRATGIPDRFSGSGSGTDFTLTISRLEPEDFAVYYCQQRVSLPYTFGQGTKLEIK

SEQ ID NO: 1131 - DNA, 21 bp, Artificial Sequence
  synthetic
cagagtattagaaacatctat

SEQ ID NO: 1132 - protein, 7 aa, Artificial Sequence
  synthetic
QSIRNIY

SEQ ID NO: 1133 - DNA, 9 bp, Artificial Sequence
  synthetic
ggtgcgtcc

SEQ ID NO: 1134 - protein, 3 aa, Artificial Sequence
  synthetic
GAS

SEQ ID NO: 1135 - DNA, 27 bp, Artificial Sequence
  synthetic
cagcagcgtgttagtttaccgtacact

SEQ ID NO: 1136 - protein, 9 aa, Artificial Sequence
  synthetic
QQRVSLPYT

SEQ ID NO: 1137 - DNA, 369 bp, Artificial Sequence
  synthetic
caggtgcagctggtggagtctgggggaggcttggtacagcctggcaggtccctgagactctcctgtgcagcctctggcttcagctttgatgattatgccatgcactgggtccggcaagctccaggacagggcctggagtgggtctcaggtattagttggaatggtggtagcagagactatgcggactctgtgaagggccgattcaccatctccagagacaacgccaggaactccctgtttctgcaaatgaacagtctgtttactgaggacacggccttgtattactgtgcaaaagataagagtggctacggctcctacttctacggtatggacgtctggggccaagggaccacggtcaccgtctcctca

SEQ ID NO: 1138 - protein, 123 aa, Artificial Sequence
  synthetic
QVQLVESGGGLVQPGRSLRLSCAASGFSFDDYAMHWVRQAPGQGLEWVSGISWNGGSRDYADSVKGRFTISRDNARNSLFLQMNSLFTEDTALYYCAKDKSGYGSYFYGMDVWGQGTTVTVSS

SEQ ID NO: 1139 - DNA, 24 bp, Artificial Sequence
  synthetic
ggcttcagctttgatgattatgcc

SEQ ID NO: 1140 - protein, 8 aa, Artificial Sequence
  synthetic
GFSFDDYA

SEQ ID NO: 1141 - DNA, 24 bp, Artificial Sequence
  synthetic
attagttggaatggtggtagcaga

SEQ ID NO: 1142 - protein, 8 aa, Artificial Sequence
  synthetic
ISWNGGSR

SEQ ID NO: 1143 - DNA, 48 bp, Artificial Sequence; identical to SEQ ID NO: 1127
  synthetic

SEQ ID NO: 1144 - protein, 16 aa, Artificial Sequence
  synthetic
AKDKSGYGSYFYGMDV

SEQ ID NO: 1145 - DNA, 324 bp, Artificial Sequence
  synthetic
gaaattgtgttgacgcagtctccaggcattctgtctttgtctccaggggacagagccaccctctcctgcagggccagtcagagtattagaaacatctatttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagttcaccgtacacttttggccaggggaccaagctggagatcaaa

SEQ ID NO: 1146 - protein, 108 aa, Artificial Sequence
  synthetic
EIVLTQSPGILSLSPGDRATLSCRASQSIRNIYLAWYQQKPGQAPRLLIHGASTRATGIPDRFSGSGSGTDFTLTISRLEPEDFAVYYCQQRVSSPYTFGQGTKLEIK

SEQ ID NO: 1147 - DNA, 21 bp, Artificial Sequence
  synthetic
cagagtattagaaacatctat

SEQ ID NO: 1148 - protein, 7 aa, Artificial Sequence
  synthetic
QSIRNIY

SEQ ID NO: 1149 - DNA, 9 bp, Artificial Sequence
  synthetic
ggtgcgtcc

SEQ ID NO: 1150 - protein, 3 aa, Artificial Sequence
  synthetic
GAS

SEQ ID NO: 1151 - DNA, 27 bp, Artificial Sequence
  synthetic
cagcagcgtgttagttcaccgtacact

SEQ ID NO: 1152 - protein, 9 aa, Artificial Sequence
  synthetic
QQRVSSPYT

SEQ ID NO: 1153 - DNA, 369 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatagtggtagcagagactatgcggactctgtgaagggccgattcaccatctccagagacaacgccaggaactccctgtttctgcaaatgaacagtctgagtactgaggacacggccttgtattactgtgcaaaagataagagtggctacggctcctactactacggtatggacgtctggggccaagggaccacggtcaccgtctcctca

SEQ ID NO: 1154 - protein, 123 aa, Artificial Sequence
  synthetic
EVQLVESGGGLVQPGRSLRLSCAASGFTFDDYAMHWVRQAPGKGLEWVSGISWNSGSRDYADSVKGRFTISRDNARNSLFLQMNSLSTEDTALYYCAKDKSGYGSYYYGMDVWGQGTTVTVSS

SEQ ID NO: 1155 - DNA, 24 bp, Artificial Sequence
  synthetic
ggattcacctttgatgattatgcc

SEQ ID NO: 1156 - protein, 8 aa, Artificial Sequence
  synthetic
GFTFDDYA

SEQ ID NO: 1157 - DNA, 24 bp, Artificial Sequence
  synthetic
attagttggaatagtggtagcaga

SEQ ID NO: 1158 - protein, 8 aa, Artificial Sequence
  synthetic
ISWNSGSR

SEQ ID NO: 1159 - DNA, 48 bp, Artificial Sequence
  synthetic
gcaaaagataagagtggctacggctcctactactacggtatggacgtc

SEQ ID NO: 1160 - protein, 16 aa, Artificial Sequence
  synthetic
AKDKSGYGSYYYGMDV

SEQ ID NO: 1161 - DNA, 324 bp, Artificial Sequence
  synthetic
gaaattgtgttgacgcagtctccaggcaccctgtctttgtctccaggggacagagccaccctctcctgcagggccagtcagagtattagaagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagctcaccgtacacttttggccaggggaccaagctggagatcaaa

SEQ ID NO: 1162 - protein, 108 aa, Artificial Sequence
  synthetic
EIVLTQSPGTLSLSPGDRATLSCRASQSIRSIYLAWYQQKPGQAPRLLIHGASTRATGIPDRFSGSGSGTDFTLTISRLEPEDFAVYYCQQRVSSPYTFGQGTKLEIK

SEQ ID NO: 1163 - DNA, 21 bp, Artificial Sequence
  synthetic
cagagtattagaagcatctac

SEQ ID NO: 1164 - protein, 7 aa, Artificial Sequence
  synthetic
QSIRSIY

SEQ ID NO: 1165 - DNA, 9 bp, Artificial Sequence
  synthetic
ggtgcgtcc

SEQ ID NO: 1166 - protein, 3 aa, Artificial Sequence
  synthetic
GAS

SEQ ID NO: 1167 - DNA, 27 bp, Artificial Sequence
  synthetic
cagcagcgtgttagctcaccgtacact

SEQ ID NO: 1168 - protein, 9 aa, Artificial Sequence
  synthetic
QQRVSSPYT

SEQ ID NO: 1169 - DNA, 369 bp, Artificial Sequence
  synthetic
gaagtgcagctggtggagtctgggggaggcttggtacagcctggcaggtccctgagactctcctgtgtagcctctggattcacctttgctgattttaccatgcactgggtccggcaagcgccagggaagggccttgagtgggtctcaggtattagttggaatagtaatagtatagactatgcggactctgtgaagggccgattcaccatctccagagacaacgccaagaaatccctgtttctgcaaatgtccagtctgagagctgaggacacggccttatattactgtgtcaaagacagaagcggatatagcagattctactacggtatggacgtctggggccaagggaccacggtcaccgtctcctca

SEQ ID NO: 1170 - protein, 123 aa, Artificial Sequence
  synthetic
EVQLVESGGGLVQPGRSLRLSCVASGFTFADFTMHWVRQAPGKGLEWVSGISWNSNSIDYADSVKGRFTISRDNAKKSLFLQMSSLRAEDTALYYCVKDRSGYSRFYYGMDVWGQGTTVTVSS

SEQ ID NO: 1171 - DNA, 24 bp, Artificial Sequence
  synthetic
ggattcacctttgctgattttacc

SEQ ID NO: 1172 - protein, 8 aa, Artificial Sequence
  synthetic
GFTFADFT

SEQ ID NO: 1173 - DNA, 24 bp, Artificial Sequence
  synthetic
attagttggaatagtaatagtata

SEQ ID NO: 1174 - protein, 8 aa, Artificial Sequence
  synthetic
ISWNSNSI

SEQ ID NO: 1175 - DNA, 48 bp, Artificial Sequence
  synthetic
gtcaaagacagaagcggatatagcagattctactacggtatggacgtc

SEQ ID NO: 1176 - protein, 16 aa, Artificial Sequence
  synthetic
VKDRSGYSRFYYGMDV

SEQ ID NO: 1177 - DNA, 321 bp, Artificial Sequence
  synthetic
gaaattgtgatgacgcagtctccagccaccctgtctgtgtctccaggggaaagagccatcctctcctgcagggccagtcagaatattaatagcaacttggcctggtaccagcagaaacctggccaggctcccaggctcctcatctatggtgcatccaccagggccactggtgtcccagccaggttcagtggcagtgggtctgggacagagttcactctcaccatccgcagcctgcaatctgaagattttgcagtttattactgtcaacaatattataattggccgatcactttcggccacgggacacgactggagattaaa

SEQ ID NO: 1178 - protein, 107 aa, Artificial Sequence
  synthetic
EIVMTQSPATLSVSPGERAILSCRASQNINSNLAWYQQKPGQAPRLLIYGASTRATGVPARFSGSGSGTEFTLTIRSLQSEDFAVYYCQQYYNWPITFGHGTRLEIK

SEQ ID NO: 1179 - DNA, 18 bp, Artificial Sequence
  synthetic
cagaatattaatagcaac

SEQ ID NO: 1180 - protein, 6 aa, Artificial Sequence
  synthetic
QNINSN

SEQ ID NO: 1181 - DNA, 9 bp, Artificial Sequence
  synthetic
ggtgcatcc

SEQ ID NO: 1182 - protein, 3 aa, Artificial Sequence
  synthetic
GAS

SEQ ID NO: 1183 - DNA, 27 bp, Artificial Sequence
  synthetic
caacaatattataattggccgatcact

SEQ ID NO: 1184 - protein, 9 aa, Artificial Sequence
  synthetic
QQYYNWPIT

SEQ ID NO: 1185 - DNA, 369 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatggtggtagtaaagactatgcggactctgtgaagggccgattcaccatctccagagacaacaccaggaactccctgtctctgcaaatgaacagtctgagaattgaagacacggccttatattactgtgcaaaagataagagtggctacggctccttctactacggtttggacgtctggggccaagggaccacggtcaccgtctcctca

SEQ ID NO: 1186 - protein, 123 aa, Artificial Sequence
  synthetic
EVQLVESGGGLVQPGRSLRLSCAASGFTFDDYAMHWVRQAPGKGLEWVSGISWNGGSKDYADSVKGRFTISRDNTRNSLSLQMNSLRIEDTALYYCAKDKSGYGSFYYGLDVWGQGTTVTVSS

SEQ ID NO: 1187 - DNA, 24 bp, Artificial Sequence
  synthetic
ggattcacctttgatgattatgcc

SEQ ID NO: 1188 - protein, 8 aa, Artificial Sequence
  synthetic
GFTFDDYA

SEQ ID NO: 1189 - DNA, 24 bp, Artificial Sequence
  synthetic
attagttggaatggtggtagtaaa

SEQ ID NO: 1190 - protein, 8 aa, Artificial Sequence
  synthetic
ISWNGGSK

SEQ ID NO: 1191 - DNA, 48 bp, Artificial Sequence
  synthetic
gcaaaagataagagtggctacggctccttctactacggtttggacgtc

SEQ ID NO: 1192 - protein, 16 aa, Artificial Sequence
  synthetic
AKDKSGYGSFYYGLDV

SEQ ID NO: 1193 - DNA, 324 bp, Artificial Sequence
  synthetic
gaaatagtgttgacacagtctccaggcaccctgtctttgtctccaggggacagagccaccctctcctgcagggccagtcagagtattagaagcatctacttagcctggtaccagcagaaacctggccaggctcccaggctcctcatccatggtgcgtccaccagggccactggcatcccagacaggttcagtggcagtgggtcagggacagacttcactctcaccatcagcagactggagcctgaagattttgcagtttattactgtcagcagcgtgttagctcaccgtacacttttggccaggggaccaagctggagatcaaa

SEQ ID NO: 1194 - protein, 108 aa, Artificial Sequence; identical to SEQ ID NO: 1162
  synthetic

SEQ ID NO: 1195 - DNA, 21 bp, Artificial Sequence
  synthetic
cagagtattagaagcatctac

SEQ ID NO: 1196 - protein, 7 aa, Artificial Sequence
  synthetic
QSIRSIY

SEQ ID NO: 1197 - DNA, 9 bp, Artificial Sequence
  synthetic
ggtgcgtcc

SEQ ID NO: 1198 - protein, 3 aa, Artificial Sequence
  synthetic
GAS

SEQ ID NO: 1199 - DNA, 27 bp, Artificial Sequence
  synthetic
cagcagcgtgttagctcaccgtacact

SEQ ID NO: 1200 - protein, 9 aa, Artificial Sequence
  synthetic
QQRVSSPYT

SEQ ID NO: 1201 - DNA, 369 bp, Artificial Sequence
  synthetic
gaggtgcagctggtggagtctgggggaggcttggtacagcctggcaggtccctgagactctcctgtgcagcctctggattcacctttgatgatttcaccatgcactgggtccggcaagctccaggaaagggcctggagtgggtctcagatattagttggaatagtggtagcatagactatgcggactctgtgaagggccgattcaccatttccagagacaatgccaggaactccctgtttctacaaatgagcagtctgagaactgaggacacggcctcgtattactgtataaaagataagagtggctacggctcctacaactacggtctggacgtctggggccaagggaccacggtcaccgtctcctca

SEQ ID NO: 1202 - protein, 123 aa, Artificial Sequence
  synthetic
EVQLVESGGGLVQPGRSLRLSCAASGFTFDDFTMHWVRQAPGKGLEWVSDISWNSGSIDYADSVKGRFTISRDNARNSLFLQMSSLRTEDTASYYCIKDKSGYGSYNYGLDVWGQGTTVTVSS

SEQ ID NO: 1203 - DNA, 24 bp, Artificial Sequence
  synthetic
ggattcacctttgatgatttcacc

SEQ ID NO: 1204 - protein, 8 aa, Artificial Sequence
  synthetic
GFTFDDFT

SEQ ID NO: 1205 - DNA, 24 bp, Artificial Sequence
  synthetic
attagttggaatagtggtagcata

SEQ ID NO: 1206 - protein, 8 aa, Artificial Sequence
  synthetic
ISWNSGSI

SEQ ID NO: 1207 - DNA, 48 bp, Artificial Sequence
  synthetic
ataaaagataagagtggctacggctcctacaactacggtctggacgtc

SEQ ID NO: 1208 - protein, 16 aa, Artificial Sequence
  synthetic
IKDKSGYGSYNYGLDV

SEQ ID NO: 1209 - DNA, 324 bp, Artificial Sequence
  synthetic
gaaattgtgttgacgcagtctccaggcaccctgtctttgtctccaggggacagagccaccctctcctgcagggccagtcagagtgttagcagcatctacttagcctggtaccagcagaaacctggccaggctcccaggctcctcatccatggtgcgtccaccagggccactggcatcccagacaggttcagtggcagtgggtcggggacagacttcactctcaccatcagcagactggagcctgaagattttgcactttattactgtcaccagcgtgttagttcaccgtacacttttggccaggggaccaagctggagatcaaa

SEQ ID NO: 1210 - protein, 108 aa, Artificial Sequence
  synthetic
EIVLTQSPGTLSLSPGDRATLSCRASQSVSSIYLAWYQQKPGQAPRLLIHGASTRATGIPDRFSGSGSGTDFTLTISRLEPEDFALYYCHQRVSSPYTFGQGTKLEIK

SEQ ID NO: 1211 - DNA, 21 bp, Artificial Sequence
  synthetic
cagagtgttagcagcatctac

SEQ ID NO: 1212 - protein, 7 aa, Artificial Sequence
  synthetic
QSVSSIY

SEQ ID NO: 1213 - DNA, 9 bp, Artificial Sequence
  synthetic
ggtgcgtcc

SEQ ID NO: 1214 - protein, 3 aa, Artificial Sequence
  synthetic
GAS

SEQ ID NO: 1215 - DNA, 27 bp, Artificial Sequence
  synthetic
caccagcgtgttagttcaccgtacact

SEQ ID NO: 1216 - protein, 9 aa, Artificial Sequence
  synthetic
HQRVSSPYT

SEQ ID NO: 1217 - DNA, 369 bp, Artificial Sequence
  synthetic
gaggtgcagctggtggagtctgggggaggcttggtacagcctggcaggtccctgagactctcctgtgcagcctctggattcacctttgatgattatgccatgcactgggtccggcaagctccaggaaagggcctggagtgggtctcaggtattagttggaatagtggtagtaaagactatgcggactctgtgaagggccgattcaccatctccagagacaacaccaggaactccctgtttctgcaaatgaacagtctgagaactgaagacacggccttatattactgtgcaaaagataagagtggctacggctccttctactacggtatggacgtctggggccaagggaccacggtcaccgtctcctca

SEQ ID NO: 1218 - protein, 123 aa, Artificial Sequence
  synthetic
EVQLVESGGGLVQPGRSLRLSCAASGFTFDDYAMHWVRQAPGKGLEWVSGISWNSGSKDYADSVKGRFTISRDNTRNSLFLQMNSLRTEDTALYYCAKDKSGYGSFYYGMDVWGQGTTVTVSS

SEQ ID NO: 1219 - DNA, 24 bp, Artificial Sequence
  synthetic
ggattcacctttgatgattatgcc

SEQ ID NO: 1220 - protein, 8 aa, Artificial Sequence
  synthetic
GFTFDDYA

SEQ ID NO: 1221 - DNA, 24 bp, Artificial Sequence
  synthetic
attagttggaatagtggtagtaaa

SEQ ID NO: 1222 - protein, 8 aa, Artificial Sequence
  synthetic
ISWNSGSK

SEQ ID NO: 1223 - DNA, 48 bp, Artificial Sequence; identical to SEQ ID NO: 1111
  synthetic

SEQ ID NO: 1224 - protein, 16 aa, Artificial Sequence
  synthetic
AKDKSGYGSFYYGMDV

SEQ ID NO: 1225 - DNA, 318 bp, Artificial Sequence
  synthetic
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctccgttcggccaagggaccaaggtggaaatcaaa

SEQ ID NO: 1226 - protein, 106 aa, Artificial Sequence
  synthetic
DIQMTQSPSTLSASVGDRVTITCRASQSISSWLAWYQQKPGKAPKLLIYKASSLESGVPSRFSGSGSGTEFTLTISSLQPDDFATYYCQQYNSYSPFGQGTKVEIK

SEQ ID NO: 1227 - DNA, 18 bp, Artificial Sequence
  synthetic
cagagtattagtagctgg

SEQ ID NO: 1228 - protein, 6 aa, Artificial Sequence
  synthetic
QSISSW

SEQ ID NO: 1229 - DNA, 9 bp, Artificial Sequence
  synthetic
aaggcgtct

SEQ ID NO: 1230 - protein, 3 aa, Artificial Sequence
  synthetic
KAS

SEQ ID NO: 1231 - DNA, 24 bp, Artificial Sequence
  synthetic
caacagtataatagttattctccg

SEQ ID NO: 1232 - protein, 8 aa, Artificial Sequence
  synthetic
QQYNSYSP

SEQ ID NO: 1233 - DNA, 372 bp, Artificial Sequence
  synthetic
caggtgcaactggtggagtctgggggaggcgtggtccagcctgggaggtccctgagactctcctgtgcagcctctggactcaccttcagtacctatgtcatgcactgggtccgccaggctccaggcaaggggctggcgtgggtggcagttatagcaaatgatggaagtaataaatattatgcagactccgtgaagggccgattcaccatctccagagacaactccaagaacacgctgtatctgcaaatgaatagcctgagacctgaggacacggctgtgtatttttgtgcgaaagaggggggtaccagtgggtcctactattactatggaatggacgtctggggtcaagggactacggtcaccgtctcctca

SEQ ID NO: 1234 - protein, 124 aa, Artificial Sequence
  synthetic
QVQLVESGGGVVQPGRSLRLSCAASGLTFSTYVMHWVRQAPGKGLAWVAVIANDGSNKYYADSVKGRFTISRDNSKNTLYLQMNSLRPEDTAVYFCAKEGGTSGSYYYYGMDVWGQGTTVTVSS

SEQ ID NO: 1235 - DNA, 24 bp, Artificial Sequence
  synthetic
ggactcaccttcagtacctatgtc

SEQ ID NO: 1236 - protein, 8 aa, Artificial Sequence
  synthetic
GLTFSTYV

SEQ ID NO: 1237 - DNA, 24 bp, Artificial Sequence
  synthetic
atagcaaatgatggaagtaataaa

SEQ ID NO: 1238 - protein, 8 aa, Artificial Sequence
  synthetic
IANDGSNK

SEQ ID NO: 1239 - DNA, 51 bp, Artificial Sequence
  synthetic
gcgaaagaggggggtaccagtgggtcctactattactatggaatggacgtc

SEQ ID NO: 1240 - protein, 17 aa, Artificial Sequence
  synthetic
AKEGGTSGSYYYYGMDV

SEQ ID NO: 1241 - DNA, 342 bp, Artificial Sequence
  synthetic
gacatccagatgacccagtctccagactccctggctgtgtctctgggcgagagggccaccatcaactgcaagtccagccagagtcttttattcaactccatcaataagaactacttagcttggtaccagcagaaaccaggacagcctcctaagcttctcctttactgggcatctacccgggaatccgggatccctgaccgattcagtggcagcgggtctgggacagatttcactctcaccatcaccagcctgcaggctgaagatgtggcactttattactgtcagcaatattatagtattccgtggacgttcggccaagggaccaaggtggaaatcaaacga

SEQ ID NO: 1242 - protein, 114 aa, Artificial Sequence
  synthetic
DIQMTQSPDSLAVSLGERATINCKSSQSLLFNSINKNYLAWYQQKPGQPPKLLLYWASTRESGIPDRFSGSGSGTDFTLTITSLQAEDVALYYCQQYYSIPWTFGQGTKVEIKR

SEQ ID NO: 1243 - DNA, 36 bp, Artificial Sequence
  synthetic
cagagtcttttattcaactccatcaataagaactac

SEQ ID NO: 1244 - protein, 12 aa, Artificial Sequence
  synthetic
QSLLFNSINKNY

SEQ ID NO: 1245 - DNA, 9 bp, Artificial Sequence
  synthetic
tgggcatct

SEQ ID NO: 1246 - protein, 3 aa, Artificial Sequence
  synthetic
WAS

SEQ ID NO: 1247 - DNA, 27 bp, Artificial Sequence
  synthetic
cagcaatattatagtattccgtggacg

SEQ ID NO: 1248 - protein, 9 aa, Artificial Sequence
  synthetic
QQYYSIPWT

SEQ ID NO: 1249 - DNA, 354 bp, Artificial Sequence
  synthetic
caggtgcagctggtggagtctggggctgaagtgaagaagcctggggcctcagtgaaggtctcctgcaagacttctggatacaccttcaccggctactatatgcactggatacgacaggcccctggacaagggcttgagtggatgggatggatcaaccctaaaagtggtggcacaaattatgcacagaagtttcagggcagggtcaccatgaccagggacacgtccatcagcacagcctacatggaactgagcaggctgagatccgacgacatggccgtgtattattgtgcgagaatgggggacggtgcagtgtttgacttctggggccagggaaccctggtcaccgtctcctca

SEQ ID NO: 1250 - protein, 118 aa, Artificial Sequence
  synthetic
QVQLVESGAEVKKPGASVKVSCKTSGYTFTGYYMHWIRQAPGQGLEWMGWINPKSGGTNYAQKFQGRVTMTRDTSISTAYMELSRLRSDDMAVYYCARMGDGAVFDFWGQGTLVTVSS

SEQ ID NO: 1251 - DNA, 24 bp, Artificial Sequence
  synthetic
ggatacaccttcaccggctactat

SEQ ID NO: 1252 - protein, 8 aa, Artificial Sequence
  synthetic
GYTFTGYY

SEQ ID NO: 1253 - DNA, 24 bp, Artificial Sequence
  synthetic
atcaaccctaaaagtggtggcaca

SEQ ID NO: 1254 - protein, 8 aa, Artificial Sequence
  synthetic
INPKSGGT

SEQ ID NO: 1255 - DNA, 33 bp, Artificial Sequence
  synthetic
gcgagaatgggggacggtgcagtgtttgacttc

SEQ ID NO: 1256 - protein, 11 aa, Artificial Sequence
  synthetic
ARMGDGAVFDF

SEQ ID NO: 1257 - DNA, 324 bp, Artificial Sequence
  synthetic
gccatccagatgacccagtctccatcctccctgtctgcatctgtaggagacagagtcaccatcacttgccgggcaagtcagaggattagcagctttttaaattggtatcagcagaaaccagggaaagcccctaagctcctgatctatactgcatccaatttacaaaatggggtcccatcaaggttcagtggcagtggatctgggacagatttcactctcactatcagcagtctgcaacctgaagattttgctacttactactgtcaacagagttacaggaccccgctcactttcggcggagggaccaaggtggaaatcaaacga

SEQ ID NO: 1258 - protein, 108 aa, Artificial Sequence
  synthetic
AIQMTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKVEIKR

SEQ ID NO: 1259 - DNA, 18 bp, Artificial Sequence
  synthetic
cagaggattagcagcttt

SEQ ID NO: 1260 - protein, 6 aa, Artificial Sequence
  synthetic
QRISSF

SEQ ID NO: 1261 - DNA, 9 bp, Artificial Sequence
  synthetic
actgcatcc

SEQ ID NO: 1262 - protein, 3 aa, Artificial Sequence
  synthetic
TAS

SEQ ID NO: 1263 - DNA, 27 bp, Artificial Sequence
  synthetic
caacagagttacaggaccccgctcact

SEQ ID NO: 1264 - protein, 9 aa, Artificial Sequence
  synthetic
QQSYRTPLT

SEQ ID NO: 1265 - DNA, 369 bp, Artificial Sequence
  synthetic
gaggtgcagctggtggagtctgggggaggcttggtacagcctggcaggtccctgagactctcctgtgcagcctctggattcacctttgatgattataccatgcactgggtccggcaagctccagggaagggcctggagtgggtctcaggtattagttggaacagtggtagcataggctatgcggactctgtgaagggccgattcaccatttccagagacaacgccaagaactccctgtatttgcaaatgaacagtctgagagctgaggacacggccttgttttactgtgcaaaagatcaaagtggttacggccactactactacggtatggacgtctggggccaagggaccacggtcaccgtctcctca

SEQ ID NO: 1266 - protein, 123 aa, Artificial Sequence
  synthetic
EVQLVESGGGLVQPGRSLRLSCAASGFTFDDYTMHWVRQAPGKGLEWVSGISWNSGSIGYADSVKGRFTISRDNAKNSLYLQMNSLRAEDTALFYCAKDQSGYGHYYYGMDVWGQGTTVTVSS

SEQ ID NO: 1267 - DNA, 24 bp, Artificial Sequence
  synthetic
ggattcacctttgatgattatacc

SEQ ID NO: 1268 - protein, 8 aa, Artificial Sequence
  synthetic
GFTFDDYT

SEQ ID NO: 1269 - DNA, 24 bp, Artificial Sequence
  synthetic
attagttggaacagtggtagcata

SEQ ID NO: 1270 - protein, 8 aa, Artificial Sequence
  synthetic
ISWNSGSI

SEQ ID NO: 1271 - DNA, 48 bp, Artificial Sequence
  synthetic
gcaaaagatcaaagtggttacggccactactactacggtatggacgtc

SEQ ID NO: 1272 - protein, 16 aa, Artificial Sequence
  synthetic
AKDQSGYGHYYYGMDV

SEQ ID NO: 1273 - DNA, 321 bp, Artificial Sequence
  synthetic
gaaatagtgatgacgcagtctccagccaccctgtctgtgtctccaggggaaagagccaccctctcctgtagggccagtcagagtgttagcagcaacttagcctggtaccagcagaaacctggccaggctcccaggctcctcatctatggtgcatccaccagggccactgatatcccagccaggttcagtggcagtgggtctgggacagagttcactctcaccatcagcagcctgcagtctgaagattttgcagtttatcactgtcagcagtataataactggccgctcactttcggcggagggaccaaggtggagatcaaa

SEQ ID NO: 1274 - protein, 107 aa, Artificial Sequence
  synthetic
EIVMTQSPATLSVSPGERATLSCRASQSVSSNLAWYQQKPGQAPRLLIYGASTRATDIPARFSGSGSGTEFTLTISSLQSEDFAVYHCQQYNNWPLTFGGGTKVEIK

SEQ ID NO: 1275 - DNA, 18 bp, Artificial Sequence
  synthetic
cagagtgttagcagcaac

SEQ ID NO: 1276 - protein, 6 aa, Artificial Sequence
  synthetic
QSVSSN

SEQ ID NO: 1277 - DNA, 9 bp, Artificial Sequence
  synthetic
ggtgcatcc

SEQ ID NO: 1278 - protein, 3 aa, Artificial Sequence
  synthetic
GAS

SEQ ID NO: 1279 - DNA, 27 bp, Artificial Sequence
  synthetic
cagcagtataataactggccgctcact

SEQ ID NO: 1280 - protein, 9 aa, Artificial Sequence
  synthetic
QQYNNWPLT

SEQ ID NO: 1281 - DNA, 387 bp, Artificial Sequence
  synthetic
gaggtgcagctggtggagtctgggggaggcgtggtccagcctgggaggtccctgagactctcctgtgcagcctctggattcaccttcagttactatggcatgcactgggtccgccaggctccaggcaaggggctggagtgggtggcagttatatcatttgatggaaagaataaatattatgcagactccgtgatgggccgattcaccatctccagagacaattccaagaatacactgtatctgcaaatgaacagcctgagagctgaggactcggctgtgtttttctgtgcgaggtcttacgacattttgactggttatggagccggttacagctaccactacggtatggacgtctggggccaagggaccacggtcaccgtctcctca

SEQ ID NO: 1282 - protein, 129 aa, Artificial Sequence
  synthetic
EVQLVESGGGVVQPGRSLRLSCAASGFTFSYYGMHWVRQAPGKGLEWVAVISFDGKNKYYADSVMGRFTISRDNSKNTLYLQMNSLRAEDSAVFFCARSYDILTGYGAGYSYHYGMDVWGQGTTVTVSS

SEQ ID NO: 1283 - DNA, 24 bp, Artificial Sequence
  synthetic
ggattcaccttcagttactatggc

SEQ ID NO: 1284 - protein, 8 aa, Artificial Sequence
  synthetic
GFTFSYYG

SEQ ID NO: 1285 - DNA, 24 bp, Artificial Sequence
  synthetic
atatcatttgatggaaagaataaa

SEQ ID NO: 1286 - protein, 8 aa, Artificial Sequence
  synthetic
ISFDGKNK

SEQ ID NO: 1287 - DNA, 66 bp, Artificial Sequence
  synthetic
gcgaggtcttacgacattttgactggttatggagccggttacagctaccactacggtatggacgtc

SEQ ID NO: 1288 - protein, 22 aa, Artificial Sequence
  synthetic
ARSYDILTGYGAGYSYHYGMDV

SEQ ID NO: 1289 - DNA, 324 bp, Artificial Sequence
  synthetic
gccatccagatgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaaggtggagatcaaacga

SEQ ID NO: 1290 - protein, 108 aa, Artificial Sequence; identical to SEQ ID NO: 1258
  synthetic

SEQ ID NO: 1291 - DNA, 18 bp, Artificial Sequence
  synthetic
cagaggattagcagcttt

SEQ ID NO: 1292 - protein, 6 aa, Artificial Sequence
  synthetic
QRISSF

SEQ ID NO: 1293 - DNA, 9 bp, Artificial Sequence
  synthetic
actgcatcc

SEQ ID NO: 1294 - protein, 3 aa, Artificial Sequence
  synthetic
TAS

SEQ ID NO: 1295 - DNA, 27 bp, Artificial Sequence
  synthetic
caacagagttacaggaccccgctcact

SEQ ID NO: 1296 - protein, 9 aa, Artificial Sequence
  synthetic
QQSYRTPLT

SEQ ID NO: 1297 - DNA, 354 bp, Artificial Sequence
  synthetic
caggtgcagctggtggagtctggggctgaagtgaagaagcctggggcctcagtgaaggtctcctgcaagacttctggatacaccctctccggctattatatgcactggatgcgacaggcccctggacaagggcttgagtggatgggatggattaaccctaaaagtggtgtcacaaattatgcacagaagtttcaggacagagtcgccatgaccagggacacgtccatcagcacagcctacatggaactgagcaggctgagatctgacgacacggccgtgtattactgtgcgagaatgggggacggtgcagtgtttgacttctgggcccagggaaccctggtcaccgtctcctca

SEQ ID NO: 1298 - protein, 118 aa, Artificial Sequence
  synthetic
QVQLVESGAEVKKPGASVKVSCKTSGYTLSGYYMHWMRQAPGQGLEWMGWINPKSGVTNYAQKFQDRVAMTRDTSISTAYMELSRLRSDDTAVYYCARMGDGAVFDFWAQGTLVTVSS

SEQ ID NO: 1299 - DNA, 24 bp, Artificial Sequence
  synthetic
ggatacaccctctccggctattat

SEQ ID NO: 1300 - protein, 8 aa, Artificial Sequence
  synthetic
GYTLSGYY

SEQ ID NO: 1301 - DNA, 24 bp, Artificial Sequence
  synthetic
attaaccctaaaagtggtgtcaca

SEQ ID NO: 1302 - protein, 8 aa, Artificial Sequence
  synthetic
INPKSGVT

SEQ ID NO: 1303 - DNA, 33 bp, Artificial Sequence; identical to SEQ ID NO: 1255
  synthetic

SEQ ID NO: 1304 - protein, 11 aa, Artificial Sequence
  synthetic
ARMGDGAVFDF

SEQ ID NO: 1305 - DNA, 324 bp, Artificial Sequence
  synthetic
gacatccagttgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaagctggagatcaaacga

SEQ ID NO: 1306 - protein, 108 aa, Artificial Sequence
  synthetic
DIQLTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKLEIKR

SEQ ID NO: 1307 - DNA, 18 bp, Artificial Sequence
  synthetic
cagaggattagcagcttt

SEQ ID NO: 1308 - protein, 6 aa, Artificial Sequence
  synthetic
QRISSF

SEQ ID NO: 1309 - DNA, 9 bp, Artificial Sequence
  synthetic
actgcatcc

SEQ ID NO: 1310 - protein, 3 aa, Artificial Sequence
  synthetic
TAS

SEQ ID NO: 1311 - DNA, 27 bp, Artificial Sequence
  synthetic
caacagagttacaggaccccgctcact

SEQ ID NO: 1312 - protein, 9 aa, Artificial Sequence
  synthetic
QQSYRTPLT

SEQ ID NO: 1313 - DNA, 372 bp, Artificial Sequence
  synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtgtcaactatatcatttgatggaagtaacaaatactatgcagactccgtgaagggccgattcaccatctccagagacaattccaagaacacgctgtatctgcaaatgaacagcctgagacctgaggacacggctgtgtattactgtgcgaaaggggggggtaccagtgggtcctacttttactacggtatggacgtctggggccaagggaccacggtcaccgtctcctca

SEQ ID NO: 1314 - protein, 124 aa, Artificial Sequence
  synthetic
QVQLVESGGGVVQPGRSLRLSCAASGFTFSSYGMHWVRQAPGKGLEWVSTISFDGSNKYYADSVKGRFTISRDNSKNTLYLQMNSLRPEDTAVYYCAKGGGTSGSYFYYGMDVWGQGTTVTVSS

SEQ ID NO: 1315 - DNA, 24 bp, Artificial Sequence
  synthetic
ggattcaccttcagtagctatggc

SEQ ID NO: 1316 - protein, 8 aa, Artificial Sequence
  synthetic
GFTFSSYG

SEQ ID NO: 1317 - DNA, 24 bp, Artificial Sequence
  synthetic
atatcatttgatggaagtaacaaa

SEQ ID NO: 1318 - protein, 8 aa, Artificial Sequence
  synthetic
ISFDGSNK

SEQ ID NO: 1319 - DNA, 51 bp, Artificial Sequence
  synthetic
gcgaaaggggggggtaccagtgggtcctacttttactacggtatggacgtc

SEQ ID NO: 1320 - protein, 17 aa, Artificial Sequence
  synthetic
AKGGGTSGSYFYYGMDV

SEQ ID NO: 1321 - DNA, 324 bp, Artificial Sequence
  synthetic
gccatccagatgacccagtctccatcctccctgtctgcatctgtaggagacagagtcaccatcacttgccgggcaagtcagaggattagcagctttttaaattggtatcagcagaaaccagggaaagcccctaagctcctaatctatactgcatccaatttacaaaatggggtcccatcaaggttcagtggcagtggatctgggacagatttcactctcaccatcagcagtctgcaacctgaagattttgcaacttactactgtcaacagagttacaggaccccgctcactttcggcggagggaccaagctggagatcaaacga

SEQ ID NO: 1322 - protein, 108 aa, Artificial Sequence
  synthetic
AIQMTQSPSSLSASVGDRVTITCRASQRISSFLNWYQQKPGKAPKLLIYTASNLQNGVPSRFSGSGSGTDFTLTISSLQPEDFATYYCQQSYRTPLTFGGGTKLEIKR

SEQ ID NO: 1323 - DNA, 18 bp, Artificial Sequence
  synthetic
cagaggattagcagcttt

SEQ ID NO: 1324 - protein, 6 aa, Artificial Sequence
  synthetic
QRISSF

SEQ ID NO: 1325 - DNA, 9 bp, Artificial Sequence
  synthetic
actgcatcc

SEQ ID NO: 1326 - protein, 3 aa, Artificial Sequence
  synthetic
TAS

SEQ ID NO: 1327 - DNA, 27 bp, Artificial Sequence
  synthetic
caacagagttacaggaccccgctcact

SEQ ID NO: 1328 - protein, 9 aa, Artificial Sequence
  synthetic
QQSYRTPLT

SEQ ID NO: 1329 - DNA, 354 bp, Artificial Sequence
  synthetic
caggttcagctggtgcagtctgggactgaggtgaagaagcctggggcctcaatgaaggtctcctgcaaggcttctggatacaccttcaccggctactatattcactgggtgcgacaggcccctggacaagggcttgagtggatgggatggatcaaccctaacagtgatgtcacaaagtatgcacagaagtttcagggcagggtcaccttgaccagggacacgtccatcagtgcagcctatattgacctgagcaggctgagatctgacgacacggccatttattactgtgcgagaatgggggacggtgcagtgtttgactactggggccagggaaccctggtcaccgtctcctca

SEQ ID NO: 1330 - protein, 118 aa, Artificial Sequence
  synthetic
QVQLVQSGTEVKKPGASMKVSCKASGYTFTGYYIHWVRQAPGQGLEWMGWINPNSDVTKYAQKFQGRVTLTRDTSISAAYIDLSRLRSDDTAIYYCARMGDGAVFDYWGQGTLVTVSS

SEQ ID NO: 1331 - DNA, 24 bp, Artificial Sequence
  synthetic
ggatacaccttcaccggctactat

SEQ ID NO: 1332 - protein, 8 aa, Artificial Sequence
  synthetic
GYTFTGYY

SEQ ID NO: 1333 - DNA, 24 bp, Artificial Sequence
  synthetic
atcaaccctaacagtgatgtcaca

SEQ ID NO: 1334 - protein, 8 aa, Artificial Sequence
  synthetic
INPNSDVT

SEQ ID NO: 1335 - DNA, 33 bp, Artificial Sequence
  synthetic
gcgagaatgggggacggtgcagtgtttgactac

SEQ ID NO: 1336 - protein, 11 aa, Artificial Sequence
  synthetic
ARMGDGAVFDY

SEQ ID NO: 1337 - DNA, 324 bp, Artificial Sequence
  synthetic
gacatccagttgacccagtctccatcctccctgtctgcatctgtaggagacagagtcaccatcacttgccgggcaagtcaacgcattagcagctatttaaattggtatcaacagaaaccagggaaagcccctaaggtgctgatctctgttgcatccagtttacaaagtggggtcccatcaaggttcagtggcagtggatttgggacagatttcactctcaccatcagcagtctgcaacctgaggattctgcatcttactactgtcaacagagttacaataccccgctcactttcggcggcgggaccaagctggagatcaaacga

SEQ ID NO: 1338 - protein, 108 aa, Artificial Sequence
  synthetic
DIQLTQSPSSLSASVGDRVTITCRASQRISSYLNWYQQKPGKAPKVLISVASSLQSGVPSRFSGSGFGTDFTLTISSLQPEDSASYYCQQSYNTPLTFGGGTKLEIKR

SEQ ID NO: 1339 - DNA, 18 bp, Artificial Sequence
  synthetic
caacgcattagcagctat

SEQ ID NO: 1340 - protein, 6 aa, Artificial Sequence
  synthetic
QRISSY

SEQ ID NO: 1341 - DNA, 9 bp, Artificial Sequence
  synthetic
gttgcatcc

SEQ ID NO: 1342 - protein, 3 aa, Artificial Sequence
  synthetic
VAS

SEQ ID NO: 1343 - DNA, 27 bp, Artificial Sequence
  synthetic
caacagagttacaataccccgctcact

SEQ ID NO: 1344 - protein, 9 aa, Artificial Sequence
  synthetic
QQSYNTPLT

SEQ ID NO: 1345 - DNA, 354 bp, Artificial Sequence
  synthetic
gaggtgcagctggtggagtctggggctgaagtgaagaagcctggggcctcagtgaaggtctcctgcaagacttctggatacagtttcattggctattatatacactggatgcgacaggcccctggacaagggcttgaatggatgggatggatcaaccctaagagtggtgtcacaaattatgcacagaggtttcagggcagggtcaccatgaccagggacacgtccatcagtactgcctacatggaactgagcaggctgaaatctgacgacacggccgtgtatttctgtgcgagaatgggggacggtgcagtgtttgacttctggggccagggaaccctggtcaccgtctcctca

SEQ ID NO: 1346 - protein, 118 aa, Artificial Sequence
  synthetic
EVQLVESGAEVKKPGASVKVSCKTSGYSFIGYYIHWMRQAPGQGLEWMGWINPKSGVTNYAQRFQGRVTMTRDTSISTAYMELSRLKSDDTAVYFCARMGDGAVFDFWGQGTLVTVSS

SEQ ID NO: 1347 - DNA, 24 bp, Artificial Sequence
  synthetic
ggatacagtttcattggctattat

SEQ ID NO: 1348 - protein, 8 aa, Artificial Sequence
  synthetic
GYSFIGYY

SEQ ID NO: 1349 - DNA, 24 bp, Artificial Sequence
  synthetic
atcaaccctaagagtggtgtcaca

SEQ ID NO: 1350 - protein, 8 aa, Artificial Sequence
  synthetic
INPKSGVT

SEQ ID NO: 1351 - DNA, 33 bp, Artificial Sequence; identical to SEQ ID NO: 1255
  synthetic

SEQ ID NO: 1352 - protein, 11 aa, Artificial Sequence
  synthetic
ARMGDGAVFDF

SEQ ID NO: 1353 - DNA, 324 bp, Artificial Sequence
  synthetic
gacatccagttgacccagtctccatcctccctgtctgcatctgtaggagacagagtcaccatcacttgccgggcaagtcagaggattagcagctttttaaattggtatcagcagaaaccagggaaagtccctaagctcctgatctatactgcatccaatttacaaaatggggtcccatcaaggttcagtggcactggatctgggacagatttcactctcaccatcagcagtctgcaacctgaagattttgcaacttactactgtcaacagagttacaggaccccgctcactttcggcggagggaccaaagtggatatcaaacga

SEQ ID NO: 1354 - protein, 108 aa, Artificial Sequence
  synthetic
DIQLTQSPSSLSASVGDRVTITCRASQRISSFLNWYQQKPGKVPKLLIYTASNLQNGVPSRFSGTGSGTDFTLTISSLQPEDFATYYCQQSYRTPLTFGGGTKVDIKR

SEQ ID NO: 1355 - DNA, 18 bp, Artificial Sequence
  synthetic
cagaggattagcagcttt

SEQ ID NO: 1356 - protein, 6 aa, Artificial Sequence
  synthetic
QRISSF

SEQ ID NO: 1357 - DNA, 9 bp, Artificial Sequence
  synthetic
actgcatcc

SEQ ID NO: 1358 - protein, 3 aa, Artificial Sequence
  synthetic
TAS

SEQ ID NO: 1359 - DNA, 27 bp, Artificial Sequence
  synthetic
caacagagttacaggaccccgctcact

SEQ ID NO: 1360 - protein, 9 aa, Artificial Sequence
  synthetic
QQSYRTPLT

SEQ ID NO: 1361 - DNA, 354 bp, Artificial Sequence
  synthetic
gaggtgcagctggtggagtctggggctgaagtgaagaagcctggggcctcagtgaaggtctcctgcaagacttctggatacaccttcaccggctactatatgcactggatacgacaggcccctggacaagggcttgagtggatgggatggatcaaccctaaaagtggtggcacaaattatgcacagaagtttcagggcagggtcaccatgaccagggacacgtccatcagcacagcctacatggaactgagcaggctgagatccgacgacatggccgtgtattattgtgcgagaatgggggacggtgcagtgtttgacttctggggccagggaaccctggtcaccgtctcctca

SEQ ID NO: 1362 - protein, 118 aa, Artificial Sequence
  synthetic
EVQLVESGAEVKKPGASVKVSCKTSGYTFTGYYMHWIRQAPGQGLEWMGWINPKSGGTNYAQKFQGRVTMTRDTSISTAYMELSRLRSDDMAVYYCARMGDGAVFDFWGQGTLVTVSS

SEQ ID NO: 1363 - DNA, 24 bp, Artificial Sequence
  synthetic
ggatacaccttcaccggctactat

SEQ ID NO: 1364 - protein, 8 aa, Artificial Sequence
  synthetic
GYTFTGYY

SEQ ID NO: 1365 - DNA, 24 bp, Artificial Sequence
  synthetic
atcaaccctaaaagtggtggcaca

SEQ ID NO: 1366 - protein, 8 aa, Artificial Sequence
  synthetic
INPKSGGT

SEQ ID NO: 1367 - DNA, 33 bp, Artificial Sequence; identical to SEQ ID NO: 1255
  synthetic

SEQ ID NO: 1368 - protein, 11 aa, Artificial Sequence
  synthetic
ARMGDGAVFDF

SEQ ID NO: 1369 - DNA, 327 bp, Artificial Sequence
  synthetic
gacatcgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgctcactttcggcggagggaccaaagtggatatcaaacga

SEQ ID NO: 1370 - protein, 109 aa, Artificial Sequence
  synthetic
DIVMTQSPSSLSASVGDRVTITCRASQSISSYLNWYQQKPGKAPKLLIYAASSLQSGVPSRFSGSGSGTDFTLTISSLQPEDFATYYCQQSYSTPPLTFGGGTKVDIKR

SEQ ID NO: 1371 - DNA, 18 bp, Artificial Sequence
  synthetic
cagagcattagcagctat

SEQ ID NO: 1372 - protein, 6 aa, Artificial Sequence
  synthetic
QSISSY

SEQ ID NO: 1373 - DNA, 9 bp, Artificial Sequence
  synthetic
gctgcatcc

SEQ ID NO: 1374 - protein, 3 aa, Artificial Sequence
  synthetic
AAS

SEQ ID NO: 1375 - DNA, 30 bp, Artificial Sequence
  synthetic
caacagagttacagtacccctccgctcact

SEQ ID NO: 1376 - protein, 10 aa, Artificial Sequence
  synthetic
QQSYSTPPLT

SEQ ID NO: 1377 - DNA, 354 bp, Artificial Sequence
  synthetic
caggttcagctggtgcagtctgggactgaggtgaagaagcctggggcctcagtgaaggtctcctgcaaggcttctggatacaccttcaccggctactatatgcactgggtgcgacaggcccctggacaagggcttgagtggatgggatggatcaaccctaacagtgatgtcacaaactatgcacagaagtttcagggcagggtcaccttgaccagggacacgtccatcagtacagcctacattgacctgagcaggctgagatctgacgacacggccatttattactgtgcgagaatgggggacggtgcagtgtttgactactggggccagggaaccctggtcaccgtctcctca

SEQ ID NO: 1378 - protein, 118 aa, Artificial Sequence
  synthetic
QVQLVQSGTEVKKPGASVKVSCKASGYTFTGYYMHWVRQAPGQGLEWMGWINPNSDVTNYAQKFQGRVTLTRDTSISTAYIDLSRLRSDDTAIYYCARMGDGAVFDYWGQGTLVTVSS

SEQ ID NO: 1379 - DNA, 24 bp, Artificial Sequence
  synthetic
ggatacaccttcaccggctactat

SEQ ID NO: 1380 - protein, 8 aa, Artificial Sequence
  synthetic
GYTFTGYY

SEQ ID NO: 1381 - DNA, 24 bp, Artificial Sequence
  synthetic
atcaaccctaacagtgatgtcaca

SEQ ID NO: 1382 - protein, 8 aa, Artificial Sequence
  synthetic
INPNSDVT

SEQ ID NO: 1383 - DNA, 33 bp, Artificial Sequence; identical to SEQ ID NO: 1335
  synthetic

SEQ ID NO: 1384 - protein, 11 aa, Artificial Sequence
  synthetic
ARMGDGAVFDY

SEQ ID NO: 1385 - DNA, 324 bp, Artificial Sequence
  synthetic
gacatccagatgacccagtctccatcctccctgtctgcatctgtaggagacagagtcaccatcacttgccgggcaagtcagcgcattagcagctatttaaattggtatcagcagaaaccagggaaagcccctaaggtgctgatctctgttgcatccagtttgcaaagtggggtcccatcaaggttcagtggcagtggatctgggacagatttcactctcaccattagtagtctgcaacctgaggattttgcatcttactactgtcaacagagttacaataccccgctcactttcggcggagggaccaaggtggagatcaaacga

SEQ ID NO: 1386 - protein, 108 aa, Artificial Sequence
  synthetic
DIQMTQSPSSLSASVGDRVTITCRASQRISSYLNWYQQKPGKAPKVLISVASSLQSGVPSRFSGSGSGTDFTLTISSLQPEDFASYYCQQSYNTPLTFGGGTKVEIKR

SEQ ID NO: 1387 - DNA, 18 bp, Artificial Sequence
  synthetic
cagcgcattagcagctat

SEQ ID NO: 1388 - protein, 6 aa, Artificial Sequence
  synthetic
QRISSY

SEQ ID NO: 1389 - DNA, 9 bp, Artificial Sequence
  synthetic
gttgcatcc

SEQ ID NO: 1390 - protein, 3 aa, Artificial Sequence
  synthetic
VAS

SEQ ID NO: 1391 - DNA, 27 bp, Artificial Sequence
  synthetic
caacagagttacaataccccgctcact

SEQ ID NO: 1392 - protein, 9 aa, Artificial Sequence
  synthetic
QQSYNTPLT

SEQ ID NO: 1393 - DNA, 381 bp, Artificial Sequence
  synthetic
caggtgcagctggtgcagtctgggggaggcttggtcaagcctggggggtccctgagactctcctgtgcagcctctggattcaccttcagtagctatgacatgagctgggtccgccaggctccagggaaggggctggagtgggtttcatacattagtagtagtggtaataccatacattacgcagactctgtgaagggccgattcaccatctccagagacaattccaagaactcactttatctgcaaatgaacagcctgagagccgaggacacggccgtgtattactgtgcgaaagccggtcccgctacggtgacacggaggtactactactactacggtttggacgtctggggccaagggaccacggtcaccgtctcctca

SEQ ID NO: 1394 - protein, 127 aa, Artificial Sequence
  synthetic
QVQLVQSGGGLVKPGGSLRLSCAASGFTFSSYDMSWVRQAPGKGLEWVSYISSSGNTIHYADSVKGRFTISRDNSKNSLYLQMNSLRAEDTAVYYCAKAGPATVTRRYYYYYGLDVWGQGTTVTVSS

SEQ ID NO: 1395 - DNA, 24 bp, Artificial Sequence
  synthetic
ggattcaccttcagtagctatgac

SEQ ID NO: 1396 - protein, 8 aa, Artificial Sequence
  synthetic
GFTFSSYD

SEQ ID NO: 1397 - DNA, 24 bp, Artificial Sequence
  synthetic
attagtagtagtggtaataccata

SEQ ID NO: 1398 - protein, 8 aa, Artificial Sequence
  synthetic
ISSSGNTI

SEQ ID NO: 1399 - DNA, 60 bp, Artificial Sequence
  synthetic
gcgaaagccggtcccgctacggtgacacggaggtactactactactacggtttggacgtc

SEQ ID NO: 1400 - protein, 20 aa, Artificial Sequence
  synthetic
AKAGPATVTRRYYYYYGLDV

SEQ ID NO: 1401 - DNA, 324 bp, Artificial Sequence
  synthetic
gacatcgtgatgacccagtctccatcctccctgtctgcatctgtacgagacagagtcaccatcacttgccgggcaagtcagagaattagcagctatttaaattggtttcagcagaaaccagggaaagcccctaaggtcctgatctatactgcatccagtttgcaaaatggggtcccatcaaggttcagtggcagtggatctgggacagatttcactctcaccatcagcagtctgcaacctgaagactttgcaacttactactgtcagcagagttacaggaccccgctcactttcggcggagggaccaaggtggagatcaaacga

SEQ ID NO: 1402 - protein, 108 aa, Artificial Sequence
  synthetic
DIVMTQSPSSLSASVRDRVTITCRASQRISSYLNWFQQKPGKAPKVLIYTASSLQNGVPSRFSGSGSGTDFTLTISSLQPEDFATYYCQQSYRTPLTFGGGTKVEIKR

SEQ ID NO: 1403 - DNA, 18 bp, Artificial Sequence
  synthetic
cagagaattagcagctat

SEQ ID NO: 1404 - protein, 6 aa, Artificial Sequence
  synthetic
QRISSY

SEQ ID NO: 1405 - DNA, 9 bp, Artificial Sequence
  synthetic
actgcatcc

SEQ ID NO: 1406 - protein, 3 aa, Artificial Sequence
  synthetic
TAS

SEQ ID NO: 1407 - DNA, 27 bp, Artificial Sequence
  synthetic
cagcagagttacaggaccccgctcact

SEQ ID NO: 1408 - protein, 9 aa, Artificial Sequence
  synthetic
QQSYRTPLT

SEQ ID NO: 1409 - DNA, 354 bp, Artificial Sequence
  synthetic
caggtgcagctggtacagtctggggctgaggtgaagaagcctggggcctcagtgaaggtctcctgcaaggcttctggatacacattcatcggctactatatgcactgggtgcgacaggcccctggacaagggcttgagtggatgggatggatcaaccctaaaagtggtggcacaaactatgcacagaagtttcagggcagggtcaccatgaccggggacacgtccatcagcacagcctacatggagctgagcaggctgagatctgacgacacggccgtgttttactgtgcgagaatgggggacggtgcaatgtttgactactggggccagggaaccctggtcaccgtctcctca

SEQ ID NO: 1410 - protein, 118 aa, Artificial Sequence
  synthetic
QVQLVQSGAEVKKPGASVKVSCKASGYTFIGYYMHWVRQAPGQGLEWMGWINPKSGGTNYAQKFQGRVTMTGDTSISTAYMELSRLRSDDTAVFYCARMGDGAMFDYWGQGTLVTVSS

SEQ ID NO: 1411 - DNA, 24 bp, Artificial Sequence
  synthetic
ggatacacattcatcggctactat

SEQ ID NO: 1412 - protein, 8 aa, Artificial Sequence
  synthetic
GYTFIGYY

SEQ ID NO: 1413 - DNA, 24 bp, Artificial Sequence
  synthetic
atcaaccctaaaagtggtggcaca

SEQ ID NO: 1414 - protein, 8 aa, Artificial Sequence
  synthetic
INPKSGGT

SEQ ID NO: 1415 - DNA, 33 bp, Artificial Sequence
  synthetic
gcgagaatgggggacggtgcaatgtttgactac

SEQ ID NO: 1416 - protein, 11 aa, Artificial Sequence
  synthetic
ARMGDGAMFDY

SEQ ID NO: 1417 - DNA, 321 bp, Artificial Sequence
  synthetic
gacatccagatgacccagtctccatcctccctgtctgcatctgtaggagacagagtcaccatcacttgccgggcaagtcagagaattagcagctatttaaattggtatcagcagaaagcagggaaagcccctaaggtcctgatctatactgcatccagtttgcaaagtggggtcccatcacgattcagtggcagtggatctgggacagatttcactctcaccatcagcagtctgcaacctgaagattttgcaacttactactgtcaacagagttacagtaccccgctcactttcggcggagggaccaaggtggagatcaaa

SEQ ID NO: 1418 - protein, 107 aa, Artificial Sequence
  synthetic
DIQMTQSPSSLSASVGDRVTITCRASQRISSYLNWYQQKAGKAPKVLIYTASSLQSGVPSRFSGSGSGTDFTLTISSLQPEDFATYYCQQSYSTPLTFGGGTKVEIK

SEQ ID NO: 1419 - DNA, 18 bp, Artificial Sequence
  synthetic
cagagaattagcagctat

SEQ ID NO: 1420 - protein, 6 aa, Artificial Sequence
  synthetic
QRISSY

SEQ ID NO: 1421 - DNA, 9 bp, Artificial Sequence
  synthetic
actgcatcc

SEQ ID NO: 1422 - protein, 3 aa, Artificial Sequence
  synthetic
TAS

SEQ ID NO: 1423 - DNA, 27 bp, Artificial Sequence
  synthetic
caacagagttacagtaccccgctcact

SEQ ID NO: 1424 - protein, 9 aa, Artificial Sequence
  synthetic
QQSYSTPLT

SEQ ID NO: 1425 - DNA, 375 bp, Artificial Sequence
  synthetic
caggtgcagctggtacagtctgggggaggcgtggtacagcctggggggtccctgagactctcctgtgcagcctctggattcacctttgatgattatgccatgcactgggtccgtcaagctccagggaagggtctggagtgggtctctcttattagtggggatggtggtagcacatactatgcagactctgtgaagggccgattcaccatctccagagacaacagcaaaaactccctgtatctgcaaatgaacagtctgagaactgaggacaccgccttgtattactgtgcaaaagatgatagcagctcgtcctggtactactactactacggtatggacgtctggggccgagggaccacggtcaccgtctcctca

SEQ ID NO: 1426 - protein, 125 aa, Artificial Sequence
  synthetic
QVQLVQSGGGVVQPGGSLRLSCAASGFTFDDYAMHWVRQAPGKGLEWVSLISGDGGSTYYADSVKGRFTISRDNSKNSLYLQMNSLRTEDTALYYCAKDDSSSSWYYYYYGMDVWGRGTTVTVSS

SEQ ID NO: 1427 - DNA, 24 bp, Artificial Sequence
  synthetic
ggattcacctttgatgattatgcc

SEQ ID NO: 1428 - protein, 8 aa, Artificial Sequence
  synthetic
GFTFDDYA

SEQ ID NO: 1429 - DNA, 24 bp, Artificial Sequence
  synthetic
attagtggggatggtggtagcaca

SEQ ID NO: 1430 - protein, 8 aa, Artificial Sequence
  synthetic
ISGDGGST

SEQ ID NO: 1431 - DNA, 54 bp, Artificial Sequence
  synthetic
gcaaaagatgatagcagctcgtcctggtactactactactacggtatggacgtc

SEQ ID NO: 1432 - protein, 18 aa, Artificial Sequence
  synthetic
AKDDSSSSWYYYYYGMDV

SEQ ID NO: 1433 - DNA, 324 bp, Artificial Sequence
  synthetic
gacatccagatgacccagtctccatcctccctgtctgcatctgtaggagacagagtcaccatcacttgccgggcaagtcagcgcattagcagctatttaaattggtatcagcagaaaccagggaaagcccctaaggtgctgatctctgttgcatccagtttgcaaagtggggtcccatcaaggttcagtggcagtggatctgggacagatttcactctcaccatcagcagtctgcaacctgaggattttgcatcttactactgtcaacagagttacaataccccgctcactttcggcggagggaccaaggtggagatcaaacga

SEQ ID NO: 1434 - protein, 108 aa, Artificial Sequence; identical to SEQ ID NO: 1386
  synthetic

SEQ ID NO: 1435 - DNA, 18 bp, Artificial Sequence
  synthetic
cagcgcattagcagctat

SEQ ID NO: 1436 - protein, 6 aa, Artificial Sequence
  synthetic
QRISSY

SEQ ID NO: 1437 - DNA, 9 bp, Artificial Sequence
  synthetic
gttgcatcc

SEQ ID NO: 1438 - protein, 3 aa, Artificial Sequence
  synthetic
VAS

SEQ ID NO: 1439 - DNA, 27 bp, Artificial Sequence
  synthetic
caacagagttacaataccccgctcact

SEQ ID NO: 1440 - protein, 9 aa, Artificial Sequence
  synthetic
QQSYNTPLT

SEQ ID NO: 1441 - DNA, 372 bp, Artificial Sequence
  synthetic
gaggtgcagctggtggagtctgggggaggcttggtacagcctggcaggtccctgagactctcctgtgcagcctctggattcacctttggtgattataccatgcactgggtccggcaagctccagggaagggcctggagtgggtctccgatattagttggaatagtggtagcaaagactatgcggactctgtgaagggccgattcaccatctccagagacaacgccaagaactccctctatcttcaaatgaacagtctgagaactgaggatacggccttttattactgtgcaaaagatagtaggggctacggtctctactaccacctcggtttggacgtctggggccaagggaccacggtcaccgtctcctca

SEQ ID NO: 1442 - protein, 124 aa, Artificial Sequence
  synthetic
EVQLVESGGGLVQPGRSLRLSCAASGFTFGDYTMHWVRQAPGKGLEWVSDISWNSGSKDYADSVKGRFTISRDNAKNSLYLQMNSLRTEDTAFYYCAKDSRGYGLYYHLGLDVWGQGTTVTVSS

SEQ ID NO: 1443 - DNA, 24 bp, Artificial Sequence
  synthetic
ggattcacctttggtgattatacc

SEQ ID NO: 1444 - protein, 8 aa, Artificial Sequence
  synthetic
GFTFGDYT

SEQ ID NO: 1445 - DNA, 24 bp, Artificial Sequence
  synthetic
attagttggaatagtggtagcaaa

SEQ ID NO: 1446 - protein, 8 aa, Artificial Sequence
  synthetic
ISWNSGSK

SEQ ID NO: 1447 - DNA, 51 bp, Artificial Sequence
  synthetic
gcaaaagatagtaggggctacggtctctactaccacctcggtttggacgtc

SEQ ID NO: 1448 - protein, 17 aa, Artificial Sequence
  synthetic
AKDSRGYGLYYHLGLDV

SEQ ID NO: 1449 - DNA, 372 bp, Artificial Sequence
  synthetic
gaggtgcagctggtggagtctgggggaggcttggtgcagcctggcaggtccctgagactctcctgtgcagcctctggattcacctttgctgattataccatgcactgggtccggcaagctccagggaagggcctggagtgggtctcagatattagttggaatagtggtagtatagcctatgcggactctgtgaagggccgattcaccatctccagagacaacgccaagaactccctctatcttcaaatgaacagtctgagaactgaggacacggccttttattactgtgcaaaagatagtaggggctacggtcactataagtacctcggtttggacgtctggggccaagggaccacggtcaccgtctcctca

SEQ ID NO: 1450 - protein, 124 aa, Artificial Sequence
  synthetic
EVQLVESGGGLVQPGRSLRLSCAASGFTFADYTMHWVRQAPGKGLEWVSDISWNSGSIAYADSVKGRFTISRDNAKNSLYLQMNSLRTEDTAFYYCAKDSRGYGHYKYLGLDVWGQGTTVTVSS

SEQ ID NO: 1451 - DNA, 24 bp, Artificial Sequence
  synthetic
ggattcacctttgctgattatacc

SEQ ID NO: 1452 - protein, 8 aa, Artificial Sequence
  synthetic
GFTFADYT

SEQ ID NO: 1453 - DNA, 24 bp, Artificial Sequence
  synthetic
attagttggaatagtggtagtata

SEQ ID NO: 1454 - protein, 8 aa, Artificial Sequence
  synthetic
ISWNSGSI

SEQ ID NO: 1455 - DNA, 51 bp, Artificial Sequence
  synthetic
gcaaaagatagtaggggctacggtcactataagtacctcggtttggacgtc

SEQ ID NO: 1456 - protein, 17 aa, Artificial Sequence
  synthetic
AKDSRGYGHYKYLGLDV

SEQ ID NO: 1457 - DNA, 372 bp, Artificial Sequence
  synthetic
gaggtgcagctggtggagtctgggggaggcatggtacagcctggcaggtccctgagactctcctgtgcagcctctggattccccttcaatgattacaccatgcactgggtccggcaagtcccagggaggggcctggagtgggtctcagatattagttggaatagcggcagtaaaggctatgcggactctgtgaagggtcgattcatcatctccagagacaacgccaagaactccctgtacctgcaaatgaacagtctgagagttgaagacacggccttgtattactgtgtaaaagatggaagtggctacgggaggttccattattacgctatggacgtctggggccaagggaccacggtcaccgtctcctca

SEQ ID NO: 1458 - protein, 124 aa, Artificial Sequence
  synthetic
EVQLVESGGGMVQPGRSLRLSCAASGFPFNDYTMHWVRQVPGRGLEWVSDISWNSGSKGYADSVKGRFIISRDNAKNSLYLQMNSLRVEDTALYYCVKDGSGYGRFHYYAMDVWGQGTTVTVSS

SEQ ID NO: 1459 - DNA, 24 bp, Artificial Sequence
  synthetic
ggattccccttcaatgattacacc

SEQ ID NO: 1460 - protein, 8 aa, Artificial Sequence
  synthetic
GFPFNDYT

SEQ ID NO: 1461 - DNA, 24 bp, Artificial Sequence
  synthetic
attagttggaatagcggcagtaaa

SEQ ID NO: 1462 - protein, 8 aa, Artificial Sequence
  synthetic
ISWNSGSK

SEQ ID NO: 1463 - DNA, 51 bp, Artificial Sequence
  synthetic
gtaaaagatggaagtggctacgggaggttccattattacgctatggacgtc

SEQ ID NO: 1464 - protein, 17 aa, Artificial Sequence
  synthetic
VKDGSGYGRFHYYAMDV

SEQ ID NO: 1465 - DNA, 372 bp, Artificial Sequence
  synthetic
gaggtgcagctggtggagtctggtggaggcttggtacagcctggcaggtccctgagactctcctgtgcagcctctggattcacctttgctgattataccatgcactgggtccgccaagttccagggaagggcctggagtgggtctcagatattagttggaatagtggtagcaaagactatgcggactctgtgaagggccgcttcaccatctccagagacaacgccaagaatttcctgtatctgcaaatgaacagtctgagagctgaagacacggccttgtattactgtgtaaaatatggaagtggctacgggaaattctacttctacgctatggacgtctggggccaagggaccacggtcaccgtctcctca

SEQ ID NO: 1466 - protein, 124 aa, Artificial Sequence
  synthetic
EVQLVESGGGLVQPGRSLRLSCAASGFTFADYTMHWVRQVPGKGLEWVSDISWNSGSKDYADSVKGRFTISRDNAKNFLYLQMNSLRAEDTALYYCVKYGSGYGKFYFYAMDVWGQGTTVTVSS

SEQ ID NO: 1467 - DNA, 24 bp, Artificial Sequence
  synthetic
ggattcacctttgctgattatacc

SEQ ID NO: 1468 - protein, 8 aa, Artificial Sequence
  synthetic
GFTFADYT

SEQ ID NO: 1469 - DNA, 24 bp, Artificial Sequence
  synthetic
attagttggaatagtggtagcaaa

SEQ ID NO: 1470 - protein, 8 aa, Artificial Sequence
  synthetic
ISWNSGSK

SEQ ID NO: 1471 - DNA, 51 bp, Artificial Sequence
  synthetic
gtaaaatatggaagtggctacgggaaattctacttctacgctatggacgtc

SEQ ID NO: 1472 - protein, 17 aa, Artificial Sequence
  synthetic
VKYGSGYGKFYFYAMDV

SEQ ID NO: 1473 - DNA, 372 bp, Artificial Sequence
  synthetic
gaggtgcagctggtgcagtctgggggaggcttggtacagcctggcaggtccctgagactctcctgtgcagcctctggattcacctttgctgattataccatgcactgggtccggcaaactccagggaagggcctggagtgggtctcaggtattagttggaatagtggtagcaaagactatgcggactctgtgaagggccgattcaccatctccagagacaacgccaagaactccctgtatctgcaaatgaacagtctgagaactgaggacacggccttgtattactgtgcaaaatatggaagtggctacgggagatatttcttctacgctatggacgtctggggccaagggaccacggtcaccgtctcctca

SEQ ID NO: 1474 - protein, 124 aa, Artificial Sequence
  synthetic
EVQLVQSGGGLVQPGRSLRLSCAASGFTFADYTMHWVRQTPGKGLEWVSGISWNSGSKDYADSVKGRFTISRDNAKNSLYLQMNSLRTEDTALYYCAKYGSGYGRYFFYAMDVWGQGTTVTVSS

SEQ ID NO: 1475 - DNA, 24 bp, Artificial Sequence
  synthetic
ggattcacctttgctgattatacc

SEQ ID NO: 1476 - protein, 8 aa, Artificial Sequence
  synthetic
GFTFADYT

SEQ ID NO: 1477 - DNA, 24 bp, Artificial Sequence
  synthetic
attagttggaatagtggtagcaaa

SEQ ID NO: 1478 - protein, 8 aa, Artificial Sequence
  synthetic
ISWNSGSK

SEQ ID NO: 1479 - DNA, 51 bp, Artificial Sequence
  synthetic
gcaaaatatggaagtggctacgggagatatttcttctacgctatggacgtc

SEQ ID NO: 1480 - protein, 17 aa, Artificial Sequence
  synthetic
AKYGSGYGRYFFYAMDV

SEQ ID NO: 1481 - DNA, 372 bp, Artificial Sequence
  synthetic
gaggtgcagctggtggagtcaaggggagccttggtacagcctggcaggtccctgagactctcctgtgcagcctctggattcgcctttaatgattataccatgcactgggtccggcaagctccagggaagggcctggagtgggtctcagatattagttggaatagtaatagtaaagactatgcggactctgtgaagggccgattcaccatctccagagacaatgccaagaactccctctatctacaaatgaacagtctgagagctgaggacacggccttgtattactgtgtaaaagatggaagtggctacgggaaattttccctctacgctttggacgtctggggccaagggaccacggtcaccgtctcctca

SEQ ID NO: 1482 - protein, 124 aa, Artificial Sequence
  synthetic
EVQLVESRGALVQPGRSLRLSCAASGFAFNDYTMHWVRQAPGKGLEWVSDISWNSNSKDYADSVKGRFTISRDNAKNSLYLQMNSLRAEDTALYYCVKDGSGYGKFSLYALDVWGQGTTVTVSS

SEQ ID NO: 1483 - DNA, 24 bp, Artificial Sequence
  synthetic
ggattcgcctttaatgattatacc

SEQ ID NO: 1484 - protein, 8 aa, Artificial Sequence
  synthetic
GFAFNDYT

SEQ ID NO: 1485 - DNA, 24 bp, Artificial Sequence
  synthetic
attagttggaatagtaatagtaaa

SEQ ID NO: 1486 - protein, 8 aa, Artificial Sequence
  synthetic
ISWNSNSK

SEQ ID NO: 1487 - DNA, 51 bp, Artificial Sequence
  synthetic
gtaaaagatggaagtggctacgggaaattttccctctacgctttggacgtc

SEQ ID NO: 1488 - protein, 17 aa, Artificial Sequence
  synthetic
VKDGSGYGKFSLYALDV

SEQ ID NO: 1489 - DNA, 372 bp, Artificial Sequence
  synthetic
caggtgcagctggtggagtctgggggaggcttggttcaccctggcaggtccctgagactctcctgtgcagcctctggattcaaatttgatgattataccatgcactgggtccggcaagctccagggaagggcctagagtgggtctcagatattagttggaatagtggtagtaaaggctatgcggactctgtgaagggccgattcaccatctccagagacaacgccaaggattccctatatctgcagatggacagtctgagagctgcagacacggccttctattactgtgcaaaagataaaagtggctacggccacttctactactacgctatggacgtctggggccaagggaccacggtcaccgtctcctca

SEQ ID NO: 1490 - protein, 124 aa, Artificial Sequence
  synthetic
QVQLVESGGGLVHPGRSLRLSCAASGFKFDDYTMHWVRQAPGKGLEWVSDISWNSGSKGYADSVKGRFTISRDNAKDSLYLQMDSLRAADTAFYYCAKDKSGYGHFYYYAMDVWGQGTTVTVSS

SEQ ID NO: 1491 - DNA, 24 bp, Artificial Sequence
  synthetic
ggattcaaatttgatgattatacc

SEQ ID NO: 1492 - protein, 8 aa, Artificial Sequence
  synthetic
GFKFDDYT

SEQ ID NO: 1493 - DNA, 24 bp, Artificial Sequence
  synthetic
attagttggaatagtggtagtaaa

SEQ ID NO: 1494 - protein, 8 aa, Artificial Sequence
  synthetic
ISWNSGSK

SEQ ID NO: 1495 - DNA, 51 bp, Artificial Sequence
  synthetic
gcaaaagataaaagtggctacggccacttctactactacgctatggacgtc

SEQ ID NO: 1496 - protein, 17 aa, Artificial Sequence
  synthetic
AKDKSGYGHFYYYAMDV

SEQ ID NO: 1497 - DNA, 372 bp, Artificial Sequence
  synthetic
gaggtgcagctggtggagtctgggggaggcttggtacaccctggcaggtccctaagactctcctgtacagcctctggattcaagtttgctgattataccatgcactgggtccggcaagctccagggaagggcctggagtgggtctcagatattagttggaatagtggtagtaaaggctatgcggactctgtaaagggccgattcaccatctccagagacaatgacaagaactccctgtatctgcaaatgaacagtctgagaggtgaggacacggccttgtattactgtgcaaaagatggaagtggctacgggaggttccacttctacgctatcgacgtctggggccaagggaccacggtcaccgtctcctca

SEQ ID NO: 1498 - protein, 124 aa, Artificial Sequence
  synthetic
EVQLVESGGGLVHPGRSLRLSCTASGFKFADYTMHWVRQAPGKGLEWVSDISWNSGSKGYADSVKGRFTISRDNDKNSLYLQMNSLRGEDTALYYCAKDGSGYGRFHFYAIDVWGQGTTVTVSS

SEQ ID NO: 1499 - DNA, 24 bp, Artificial Sequence
  synthetic
ggattcaagtttgctgattatacc

SEQ ID NO: 1500 - protein, 8 aa, Artificial Sequence
  synthetic
GFKFADYT

SEQ ID NO: 1501 - DNA, 24 bp, Artificial Sequence
  synthetic
attagttggaatagtggtagtaaa

SEQ ID NO: 1502 - protein, 8 aa, Artificial Sequence
  synthetic
ISWNSGSK

SEQ ID NO: 1503 - DNA, 51 bp, Artificial Sequence
  synthetic
gcaaaagatggaagtggctacgggaggttccacttctacgctatcgacgtc

SEQ ID NO: 1504 - protein, 17 aa, Artificial Sequence
  synthetic
AKDGSGYGRFHFYAIDV

SEQ ID NO: 1505 - DNA, 372 bp, Artificial Sequence
  synthetic
gaggtgcagctggtggagtctgggggaggcttggtacagcctggcaggtccctgagactctcctgtgtagcctctggattcacctttgatgattattccatgcactgggtccggcaagctccagggaagggcctggagtgggtctcaggtattagttggaatagtggtagcaaagactatgcggactctgtgaagggccgattcaccatctccagagacaacgccaagaactccctgtatctgcaaatgaacagtctgagagctgaagacacggccttgtattactgtgcaaaatatggaagtggctacgggaagttctaccactacggtttggacgtctggggccaagggaccacggtcaccgtctcctca

SEQ ID NO: 1506 - protein, 124 aa, Artificial Sequence
  synthetic
EVQLVESGGGLVQPGRSLRLSCVASGFTFDDYSMHWVRQAPGKGLEWVSGISWNSGSKDYADSVKGRFTISRDNAKNSLYLQMNSLRAEDTALYYCAKYGSGYGKFYHYGLDVWGQGTTVTVSS

SEQ ID NO: 1507 - DNA, 24 bp, Artificial Sequence
  synthetic
ggattcacctttgatgattattcc

SEQ ID NO: 1508 - protein, 8 aa, Artificial Sequence
  synthetic
GFTFDDYS

SEQ ID NO: 1509 - DNA, 24 bp, Artificial Sequence
  synthetic
attagttggaatagtggtagcaaa

SEQ ID NO: 1510 - protein, 8 aa, Artificial Sequence
  synthetic
ISWNSGSK

SEQ ID NO: 1511 - DNA, 51 bp, Artificial Sequence
  synthetic
gcaaaatatggaagtggctacgggaagttctaccactacggtttggacgtc

SEQ ID NO: 1512 - protein, 17 aa, Artificial Sequence
  synthetic
AKYGSGYGKFYHYGLDV

SEQ ID NO: 1513 - DNA, 372 bp, Artificial Sequence
  synthetic
caggtgcagttggtggagtctgggggaggcttggtacagcctggcaggtccctgagactctcctgtgcagcctctggattcacctttgctgattataccatgcactgggtccggcaggctccagggaagggcctggagtgggtctcagatattagttggaatagtggtagcatgggctatgcggactctgtgaagggccgattcaccatctccagagacaacgccaagaaatccctgtatctgcaaatgaacagtctgagaactgaggacacggccttgtattactgtgcaaaagatggaagtggctacgggaaatacttcttctacgctatggacgtctggggccaagggaccacggtcaccgtctcctca

SEQ ID NO: 1514 - protein, 124 aa, Artificial Sequence
  synthetic
QVQLVESGGGLVQPGRSLRLSCAASGFTFADYTMHWVRQAPGKGLEWVSDISWNSGSMGYADSVKGRFTISRDNAKKSLYLQMNSLRTEDTALYYCAKDGSGYGKYFFYAMDVWGQGTTVTVSS

SEQ ID NO: 1515 - DNA, 24 bp, Artificial Sequence
  synthetic
ggattcacctttgctgattatacc

SEQ ID NO: 1516 - protein, 8 aa, Artificial Sequence
  synthetic
GFTFADYT

SEQ ID NO: 1517 - DNA, 24 bp, Artificial Sequence
  synthetic
attagttggaatagtggtagcatg

SEQ ID NO: 1518 - protein, 8 aa, Artificial Sequence
  synthetic
ISWNSGSM

SEQ ID NO: 1519 - DNA, 51 bp, Artificial Sequence
  synthetic
gcaaaagatggaagtggctacgggaaatacttcttctacgctatggacgtc

SEQ ID NO: 1520 - protein, 17 aa, Artificial Sequence
  synthetic
AKDGSGYGKYFFYAMDV

SEQ ID NO: 1521 - DNA, 372 bp, Artificial Sequence
  synthetic
gaggtgcagctggtgcagtctgggggaggcttggtacagcctggcaggtccctgagactctcctgtgcagcctctggattcaccttttctgattatactatgcattgggtccggcaaggtccagggaagggcctggagtgggtctcagatattagttggaatagtggtagtaaaggctatacggactctgtgaagggccgattcaccatttccagagacaacgccaagaagtccctgtatctacaaatgaacagtctgagagctgaggacacggccttgtactactgtgtaaaagatggaagtggctacgggaaataccacttctacgctatggacgtctggggccaagggaccctggtcaccgtctcctca

SEQ ID NO: 1522 - protein, 124 aa, Artificial Sequence
  synthetic
EVQLVQSGGGLVQPGRSLRLSCAASGFTFSDYTMHWVRQGPGKGLEWVSDISWNSGSKGYTDSVKGRFTISRDNAKKSLYLQMNSLRAEDTALYYCVKDGSGYGKYHFYAMDVWGQGTLVTVSS

SEQ ID NO: 1523 - DNA, 24 bp, Artificial Sequence
  synthetic
ggattcaccttttctgattatact

SEQ ID NO: 1524 - protein, 8 aa, Artificial Sequence
  synthetic
GFTFSDYT

SEQ ID NO: 1525 - DNA, 24 bp, Artificial Sequence
  synthetic
attagttggaatagtggtagtaaa

SEQ ID NO: 1526 - protein, 8 aa, Artificial Sequence
  synthetic
ISWNSGSK

SEQ ID NO: 1527 - DNA, 51 bp, Artificial Sequence
  synthetic
gtaaaagatggaagtggctacgggaaataccacttctacgctatggacgtc

SEQ ID NO: 1528 - protein, 17 aa, Artificial Sequence
  synthetic
VKDGSGYGKYHFYAMDV

SEQ ID NO: 1529 - DNA, 372 bp, Artificial Sequence
  synthetic
gaggtgcagctggtggagtcggggggaggcttggttcaccctggcaggtccctgagactctcctgtgcagcctctggattcacctttgatgattataccatgcactgggtccggcaagctccagggaagggcctggaatgggtctcagatattagttggaatagtggtagcagaggctatgcggactctgtgaagggccgattcaccatctccagagataatgccgagaactccctgtacctgcaaatgaacagtctgagagctgaggacacggccttgtattactgtgcaaaagataaaagtggctacggccactactactactacgctatggacgtctggggccaagggaccacggtcaccgtctcctca

SEQ ID NO: 1530 - protein, 124 aa, Artificial Sequence
  synthetic
EVQLVESGGGLVHPGRSLRLSCAASGFTFDDYTMHWVRQAPGKGLEWVSDISWNSGSRGYADSVKGRFTISRDNAENSLYLQMNSLRAEDTALYYCAKDKSGYGHYYYYAMDVWGQGTTVTVSS

SEQ ID NO: 1531 - DNA, 24 bp, Artificial Sequence
  synthetic
ggattcacctttgatgattatacc

SEQ ID NO: 1532 - protein, 8 aa, Artificial Sequence
  synthetic
GFTFDDYT

SEQ ID NO: 1533 - DNA, 24 bp, Artificial Sequence
  synthetic
attagttggaatagtggtagcaga

SEQ ID NO: 1534 - protein, 8 aa, Artificial Sequence
  synthetic
ISWNSGSR

SEQ ID NO: 1535 - DNA, 51 bp, Artificial Sequence
  synthetic
gcaaaagataaaagtggctacggccactactactactacgctatggacgtc

SEQ ID NO: 1536 - protein, 17 aa, Artificial Sequence
  synthetic
AKDKSGYGHYYYYAMDV

SEQ ID NO: 1537 - DNA, 372 bp, Artificial Sequence
  synthetic
gaggtgcagctggtggagtctgggggaggcttggtacagcctggcgggtccctgagactctcctgtgaagcctctggattcacctttgctgattataccttgcactgggtccggcaagctccagggaagggcctggaatgggtctcagatattagttggaatagtggcaccagaggctatgcggactctgtgaggggccgattcaccatctccagagacaacgccaagaagtccctgtatctgcaaatgaacagtctgagatctgaggacacggccttgtattactgtgtgaaagatggaagtggctacgggagatataatttctacgctatggacgtctggggccaagggaccacggtcaccgtctcctca

SEQ ID NO: 1538 - protein, 124 aa, Artificial Sequence
  synthetic
EVQLVESGGGLVQPGGSLRLSCEASGFTFADYTLHWVRQAPGKGLEWVSDISWNSGTRGYADSVRGRFTISRDNAKKSLYLQMNSLRSEDTALYYCVKDGSGYGRYNFYAMDVWGQGTTVTVSS

SEQ ID NO: 1539 - DNA, 24 bp, Artificial Sequence
  synthetic
ggattcacctttgctgattatacc

SEQ ID NO: 1540 - protein, 8 aa, Artificial Sequence
  synthetic
GFTFADYT

SEQ ID NO: 1541 - DNA, 24 bp, Artificial Sequence
  synthetic
attagttggaatagtggcaccaga

SEQ ID NO: 1542 - protein, 8 aa, Artificial Sequence
  synthetic
ISWNSGTR

SEQ ID NO: 1543 - DNA, 51 bp, Artificial Sequence
  synthetic
gtgaaagatggaagtggctacgggagatataatttctacgctatggacgtc

SEQ ID NO: 1544 - protein, 17 aa, Artificial Sequence
  synthetic
VKDGSGYGRYNFYAMDV

SEQ ID NO: 1545 - DNA, 369 bp, Artificial Sequence
  synthetic
gaggtgcagctggtggagtctgggggaggcttggttcagcctggcaggtccctgagactctcctgtgcagcctctggatttacctttgctgactataccatgcactgggtccggcaaggtccagggaagggcctggagtgggtctcagatattggttggaatagtaatactataggctatgcggactctgtgaagggccgattcgccatctccagagacaacgccaagaactccctgtatcttcaaatgaacagtctgcgacctgaggacacggccttatattactgtgtaaaggataaaagtggctacgggaaattccaatacggtttggacgtctggggccaagggaccacggtcaccgtctcctca

SEQ ID NO: 1546 - protein, 123 aa, Artificial Sequence
  synthetic
EVQLVESGGGLVQPGRSLRLSCAASGFTFADYTMHWVRQGPGKGLEWVSDIGWNSNTIGYADSVKGRFAISRDNAKNSLYLQMNSLRPEDTALYYCVKDKSGYGKFQYGLDVWGQGTTVTVSS

SEQ ID NO: 1547 - DNA, 24 bp, Artificial Sequence
  synthetic
ggatttacctttgctgactatacc

SEQ ID NO: 1548 - protein, 8 aa, Artificial Sequence
  synthetic
GFTFADYT

SEQ ID NO: 1549 - DNA, 24 bp, Artificial Sequence
  synthetic
attggttggaatagtaatactata

SEQ ID NO: 1550 - protein, 8 aa, Artificial Sequence
  synthetic
IGWNSNTI

SEQ ID NO: 1551 - DNA, 48 bp, Artificial Sequence
  synthetic
gtaaaggataaaagtggctacgggaaattccaatacggtttggacgtc

SEQ ID NO: 1552 - protein, 16 aa, Artificial Sequence
  synthetic
VKDKSGYGKFQYGLDV

SEQ ID NO: 1553 - DNA, 369 bp, Artificial Sequence
  synthetic
gaggtgcagctggtggagtctgggggaggcttggtacagcctggcaggtccctgagactctcctgtgcagcctctggatttacatttgacgattataccatgcactgggtccggcaaggtccagggaagggcctggagtgggtctcagatattggttggaatagtaacagtataggctatgcggactctgtgaagggccgattcaccatctccagagacaacgccaagaactccctgtatctccaaatgaacagtctgagacctgaggacacggccttgtatttctgtgtaaaggataaaagtggctacgggaaatttttcatcggtttggacgtctggggccaagggacaatggtcaccgtctcttca

SEQ ID NO: 1554 - protein, 123 aa, Artificial Sequence
  synthetic
EVQLVESGGGLVQPGRSLRLSCAASGFTFDDYTMHWVRQGPGKGLEWVSDIGWNSNSIGYADSVKGRFTISRDNAKNSLYLQMNSLRPEDTALYFCVKDKSGYGKFFIGLDVWGQGTMVTVSS

SEQ ID NO: 1555 - DNA, 24 bp, Artificial Sequence
  synthetic
ggatttacatttgacgattatacc

SEQ ID NO: 1556 - protein, 8 aa, Artificial Sequence
  synthetic
GFTFDDYT

SEQ ID NO: 1557 - DNA, 24 bp, Artificial Sequence
  synthetic
attggttggaatagtaacagtata

SEQ ID NO: 1558 - protein, 8 aa, Artificial Sequence
  synthetic
IGWNSNSI

SEQ ID NO: 1559 - DNA, 48 bp, Artificial Sequence
  synthetic
gtaaaggataaaagtggctacgggaaatttttcatcggtttggacgtc

SEQ ID NO: 1560 - protein, 16 aa, Artificial Sequence
  synthetic
VKDKSGYGKFFIGLDV

SEQ ID NO: 1561 - DNA, 369 bp, Artificial Sequence
  synthetic
caggtgcagttggtggagtctgggggaggcttggtacagcctggcaggtccctgagactctcctgtgcagcctctggatttacatttgacgattataccatgcactgggtccggcaaggtccagggaagggcctggagtgggtctcagatattggttggaatagtaatactaaaggctatgcggactctgtgaagggccgattcaccatctccagagacaacgccaagaattccctgtatctccaaatgaacagtctgagacctgaggacacggccttgtatttctgtgtgaaggataaaagtggctacgggaaatttttcatcggtttggacgtctggggccaagggacaatggtcaccgtctcttca

SEQ ID NO: 1562 - protein, 123 aa, Artificial Sequence
  synthetic
QVQLVESGGGLVQPGRSLRLSCAASGFTFDDYTMHWVRQGPGKGLEWVSDIGWNSNTKGYADSVKGRFTISRDNAKNSLYLQMNSLRPEDTALYFCVKDKSGYGKFFIGLDVWGQGTMVTVSS

SEQ ID NO: 1563 - DNA, 24 bp, Artificial Sequence
  synthetic
ggatttacatttgacgattatacc

SEQ ID NO: 1564 - protein, 8 aa, Artificial Sequence
  synthetic
GFTFDDYT

SEQ ID NO: 1565 - DNA, 24 bp, Artificial Sequence
  synthetic
attggttggaatagtaatactaaa

SEQ ID NO: 1566 - protein, 8 aa, Artificial Sequence
  synthetic
IGWNSNTK

SEQ ID NO: 1567 - DNA, 48 bp, Artificial Sequence
  synthetic
gtgaaggataaaagtggctacgggaaatttttcatcggtttggacgtc

SEQ ID NO: 1568 - protein, 16 aa, Artificial Sequence
  synthetic
VKDKSGYGKFFIGLDV

SEQ ID NO: 1569 - DNA, 369 bp, Artificial Sequence
  synthetic
gaggtgcagctggtggagtctgggggaggcttggtccagcctgggcggtccctgagactctcctgtgcagcctccggattcacctttgctgattataccatgcactgggtccggcaaggtccagggacgggcctggagtgggtctcagatattggttggagtggtggtagtttaggctatgcggactctgtgaagggccgattcaccatctccagagacaacgccaagaactccctgtatttggaaatgaacaatctgcgacctgaagacacggccttgtattattgtgtaaaggataaaagtggctacgggaaattccagtacggtttggacgtctggggccaagggaccacggtcaccgtctcctca

SEQ ID NO: 1570 - protein, 123 aa, Artificial Sequence
  synthetic
EVQLVESGGGLVQPGRSLRLSCAASGFTFADYTMHWVRQGPGTGLEWVSDIGWSGGSLGYADSVKGRFTISRDNAKNSLYLEMNNLRPEDTALYYCVKDKSGYGKFQYGLDVWGQGTTVTVSS

SEQ ID NO: 1571 - DNA, 24 bp, Artificial Sequence
  synthetic
ggattcacctttgctgattatacc

SEQ ID NO: 1572 - protein, 8 aa, Artificial Sequence
  synthetic
GFTFADYT

SEQ ID NO: 1573 - DNA, 24 bp, Artificial Sequence
  synthetic
attggttggagtggtggtagttta

SEQ ID NO: 1574 - protein, 8 aa, Artificial Sequence
  synthetic
IGWSGGSL

SEQ ID NO: 1575 - DNA, 48 bp, Artificial Sequence
  synthetic
gtaaaggataaaagtggctacgggaaattccagtacggtttggacgtc

SEQ ID NO: 1576 - protein, 16 aa, Artificial Sequence
  synthetic
VKDKSGYGKFQYGLDV

SEQ ID NO: 1577 - DNA, 369 bp, Artificial Sequence
  synthetic
gaggtgcagctggtggagtctgggggaggcgtggtacagcctggcaggtccctgagactctcctgtgcagcctctgggtttaaatttgatggttataccatgcactgggtccggcaaggtccagggaagggcctggagtgggtctcagatattggttggaatagtaacactataggctatgcggactctgtgaagggccgattcaccatctccagagacaacgccaagaactccctgtatctccaaatgaacagtctgagaccagaggacacggccttgtatttctgtgtaaaggataaaagtggctacgggaaatttttcatcggtttggacgtctggggccaagggacaatggtcaccgtctcttca

SEQ ID NO: 1578 - protein, 123 aa, Artificial Sequence
  synthetic
EVQLVESGGGVVQPGRSLRLSCAASGFKFDGYTMHWVRQGPGKGLEWVSDIGWNSNTIGYADSVKGRFTISRDNAKNSLYLQMNSLRPEDTALYFCVKDKSGYGKFFIGLDVWGQGTMVTVSS

SEQ ID NO: 1579 - DNA, 24 bp, Artificial Sequence
  synthetic
gggtttaaatttgatggttatacc

SEQ ID NO: 1580 - protein, 8 aa, Artificial Sequence
  synthetic
GFKFDGYT

SEQ ID NO: 1581 - DNA, 24 bp, Artificial Sequence
  synthetic
attggttggaatagtaacactata

SEQ ID NO: 1582 - protein, 8 aa, Artificial Sequence
  synthetic
IGWNSNTI

SEQ ID NO: 1583 - DNA, 48 bp, Artificial Sequence; identical to SEQ ID NO: 1559
  synthetic

SEQ ID NO: 1584 - protein, 16 aa, Artificial Sequence
  synthetic
VKDKSGYGKFFIGLDV

SEQ ID NO: 1585 - DNA, 369 bp, Artificial Sequence
  synthetic
caggtgcagctggtggagtctgggggaggcttggtacagcctggcaggtccctgagactctcctgtgcagcctctggattcacctttgatgattataccatgcactgggtccggcaaggtccagggaagggcctggagtgggtctcagatattggttggaatagtaatactataggctatgcggactctgtgaagggccgattcaccatctccagagacaacgccaggaactccctgtatctgcaaatgaacagtctgcgacctgaagacacggccttatattactgtgtaaaggataaaagtggctacgggaaattccaatacggtttggacgtctggggccaagggaccacggtcaccgtctcctca

SEQ ID NO: 1586 - protein, 123 aa, Artificial Sequence
  synthetic
QVQLVESGGGLVQPGRSLRLSCAASGFTFDDYTMHWVRQGPGKGLEWVSDIGWNSNTIGYADSVKGRFTISRDNARNSLYLQMNSLRPEDTALYYCVKDKSGYGKFQYGLDVWGQGTTVTVSS

SEQ ID NO: 1587 - DNA, 24 bp, Artificial Sequence
  synthetic
ggattcacctttgatgattatacc

SEQ ID NO: 1588 - protein, 8 aa, Artificial Sequence
  synthetic
GFTFDDYT

SEQ ID NO: 1589 - DNA, 24 bp, Artificial Sequence
  synthetic
attggttggaatagtaatactata

SEQ ID NO: 1590 - protein, 8 aa, Artificial Sequence
  synthetic
IGWNSNTI

SEQ ID NO: 1591 - DNA, 48 bp, Artificial Sequence; identical to SEQ ID NO: 1551
  synthetic

SEQ ID NO: 1592 - protein, 16 aa, Artificial Sequence
  synthetic
VKDKSGYGKFQYGLDV

SEQ ID NO: 1593 - DNA, 369 bp, Artificial Sequence
  synthetic
caggtgcaactggtggagtctgggggaggcttggtacagcctggcaggtccctgagactctcctgtgcagcctctggattcaagtttgatgattataccatgcactgggtccggcaaggtccagggaagggcctggagtgggtctcagacattagttggagtggtggtagcatagactatacggactctgtgaagggccgattctccatctccagagacaacgccaagaactccctgtatctgcaaatgaacagtctgagagttgaagacacggccttgtattattgtgtaaaagataaaagtggctacgggaagtactcttacggtttggacgtctggggccaagggaccacggtcaccgtctcctca

SEQ ID NO: 1594 - protein, 123 aa, Artificial Sequence
  synthetic
QVQLVESGGGLVQPGRSLRLSCAASGFKFDDYTMHWVRQGPGKGLEWVSDISWSGGSIDYTDSVKGRFSISRDNAKNSLYLQMNSLRVEDTALYYCVKDKSGYGKYSYGLDVWGQGTTVTVSS

SEQ ID NO: 1595 - DNA, 24 bp, Artificial Sequence
  synthetic
ggattcaagtttgatgattatacc

SEQ ID NO: 1596 - protein, 8 aa, Artificial Sequence
  synthetic
GFKFDDYT

SEQ ID NO: 1597 - DNA, 24 bp, Artificial Sequence
  synthetic
attagttggagtggtggtagcata

SEQ ID NO: 1598 - protein, 8 aa, Artificial Sequence
  synthetic
ISWSGGSI

SEQ ID NO: 1599 - DNA, 48 bp, Artificial Sequence
  synthetic
gtaaaagataaaagtggctacgggaagtactcttacggtttggacgtc

SEQ ID NO: 1600 - protein, 16 aa, Artificial Sequence
  synthetic
VKDKSGYGKYSYGLDV

SEQ ID NO: 1601 - DNA, 357 bp, Artificial Sequence
  synthetic
gaggtgcagctggtggagtctgggggaggcttggtaaagccgggggggtcccttagaatctcctgtgcagcctctggattctctttcattaacgcctggatgaactgggtccgccaggctccagggaaggggctggagtgggttggccgtattaaaagcataagtgatggtgggacaacagactacgctgcatccgtgaaaggcagattcaccatctcaagagaagattcaaaaaatatgctgtttctggaaatgaatagtctgaaaaccgaggacacagccgtgttttactgtaccacagaggtcgctagaactccgaactactggggccggggaaccctggtcaccgtctcctca

SEQ ID NO: 1602 - protein, 119 aa, Artificial Sequence
  synthetic
EVQLVESGGGLVKPGGSLRISCAASGFSFINAWMNWVRQAPGKGLEWVGRIKSISDGGTTDYAASVKGRFTISREDSKNMLFLEMNSLKTEDTAVFYCTTEVARTPNYWGRGTLVTVSS

SEQ ID NO: 1603 - DNA, 24 bp, Artificial Sequence
  synthetic
ggattctctttcattaacgcctgg

SEQ ID NO: 1604 - protein, 8 aa, Artificial Sequence
  synthetic
GFSFINAW

SEQ ID NO: 1605 - DNA, 30 bp, Artificial Sequence
  synthetic
attaaaagcataagtgatggtgggacaaca

SEQ ID NO: 1606 - protein, 10 aa, Artificial Sequence
  synthetic
IKSISDGGTT

SEQ ID NO: 1607 - DNA, 30 bp, Artificial Sequence
  synthetic
accacagaggtcgctagaactccgaactac

SEQ ID NO: 1608 - protein, 10 aa, Artificial Sequence
  synthetic
TTEVARTPNY

SEQ ID NO: 1609 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggactggacgtgtggggacaagggacaacagtgacagtgagtagc

SEQ ID NO: 1610 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYHYGLDVWGQGTTVTVSS

SEQ ID NO: 1611 - DNA, 24 bp, Artificial Sequence
  synthetic
gggtttacattcgacgattacagc

SEQ ID NO: 1612 - protein, 8 aa, Artificial Sequence
  synthetic
GFTFDDYS

SEQ ID NO: 1613 - DNA, 24 bp, Artificial Sequence
  synthetic
atatcatggaactcaggaagcaag

SEQ ID NO: 1614 - protein, 8 aa, Artificial Sequence
  synthetic
ISWNSGSK

SEQ ID NO: 1615 - DNA, 51 bp, Artificial Sequence
  synthetic
gcaaaatacggcagtggttatggcaagttttatcattatggactggacgtg

SEQ ID NO: 1616 - protein, 17 aa, Artificial Sequence
  synthetic
AKYGSGYGKFYHYGLDV

SEQ ID NO: 1617 - DNA, 372 bp, Artificial Sequence
  synthetic
gaagtacaactggtcgaatctggaggaggtcttgttcaacctggtcgatcacttcgcctttcttgtgccgcttctggtttcactttcgacgattatagcatgcattgggtacgacaggctcccggaaaagggctggaatgggtgtcaggaattagttggaactcaggaagtattggatacgctgattcagtcaaaggacgcttcacaatctcaagggacaacgctaaaaactcactttatttgcaaatgaactctctccgcgctgaagataccgctctctattattgcgccaaagatgggtctggttacggttatttttactactatggaatggacgtttggggccaaggaacaactgtcacagtatcatcc

SEQ ID NO: 1618 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGYFYYYGMDVWGQGTTVTVSS

SEQ ID NO: 1619 - DNA, 24 bp, Artificial Sequence
  synthetic
ggtttcactttcgacgattatagc

SEQ ID NO: 1620 - protein, 8 aa, Artificial Sequence
  synthetic
GFTFDDYS

SEQ ID NO: 1621 - DNA, 24 bp, Artificial Sequence
  synthetic
attagttggaactcaggaagtatt

SEQ ID NO: 1622 - protein, 8 aa, Artificial Sequence
  synthetic
ISWNSGSI

SEQ ID NO: 1623 - DNA, 51 bp, Artificial Sequence
  synthetic
gccaaagatgggtctggttacggttatttttactactatggaatggacgtt

SEQ ID NO: 1624 - protein, 17 aa, Artificial Sequence
  synthetic
AKDGSGYGYFYYYGMDV

SEQ ID NO: 1625 - DNA, 372 bp, Artificial Sequence
  synthetic
gaagtgcaactcgttgaaagcggaggaggactggtccagcccggcagatctctcagattgtcttgcgctgcatccggatttacatttgacgactattcaatgcactgggtacggcaagccccaggtaaaggactcgaatgggtaagcggcatatcttggaactcaggcagtattggctacgcagattcagtaaaaggaagattcactatttcaagggataatgctaagaacagtctctacttgcaaatgaatagcttgcgcgcagaagatacagcactttattattgtgcaaaagatggaagcggttatgggaaattttattattatggtatggatgtatggggtcaaggtacaacagttactgtgtcaagt

SEQ ID NO: 1626 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYYYGMDVWGQGTTVTVSS

SEQ ID NO: 1627 - DNA, 24 bp, Artificial Sequence
  synthetic
ggatttacatttgacgactattca

SEQ ID NO: 1628 - protein, 8 aa, Artificial Sequence
  synthetic
GFTFDDYS

SEQ ID NO: 1629 - DNA, 24 bp, Artificial Sequence
  synthetic
atatcttggaactcaggcagtatt

SEQ ID NO: 1630 - protein, 8 aa, Artificial Sequence
  synthetic
ISWNSGSI

SEQ ID NO: 1631 - DNA, 51 bp, Artificial Sequence
  synthetic
gcaaaagatggaagcggttatgggaaattttattattatggtatggatgta

SEQ ID NO: 1632 - protein, 17 aa, Artificial Sequence
  synthetic
AKDGSGYGKFYYYGMDV

SEQ ID NO: 1633 - DNA, 324 bp, Artificial Sequence; identical to SEQ ID NO: 393
  synthetic

SEQ ID NO: 1634 - protein, 108 aa, Artificial Sequence; identical to SEQ ID NO: 394
  synthetic

SEQ ID NO: 1635 - DNA, 18 bp, Artificial Sequence
  synthetic
cagagcattagcagctat

SEQ ID NO: 1636 - protein, 6 aa, Artificial Sequence
  synthetic
QSISSY

SEQ ID NO: 1637 - DNA, 9 bp, Artificial Sequence
  synthetic
gctgcatcc

SEQ ID NO: 1638 - protein, 3 aa, Artificial Sequence
  synthetic
AAS

SEQ ID NO: 1639 - DNA, 30 bp, Artificial Sequence; identical to SEQ ID NO: 31
  synthetic

SEQ ID NO: 1640 - protein, 10 aa, Artificial Sequence
  synthetic
QQSYSTPPIT

SEQ ID NO: 1641 - DNA, 369 bp, Artificial Sequence; identical to SEQ ID NO: 513
  synthetic

SEQ ID NO: 1642 - protein, 123 aa, Artificial Sequence; identical to SEQ ID NO: 514
  synthetic

SEQ ID NO: 1643 - DNA, 24 bp, Artificial Sequence
  synthetic
ggattcacctttgatgattatacc

SEQ ID NO: 1644 - protein, 8 aa, Artificial Sequence
  synthetic
GFTFDDYT

SEQ ID NO: 1645 - DNA, 24 bp, Artificial Sequence
  synthetic
attagttggaatagtggtagtata

SEQ ID NO: 1646 - protein, 8 aa, Artificial Sequence
  synthetic
ISWNSGSI

SEQ ID NO: 1647 - DNA, 48 bp, Artificial Sequence; identical to SEQ ID NO: 519
  synthetic

SEQ ID NO: 1648 - protein, 16 aa, Artificial Sequence
  synthetic
AKDNSGYGHYYYGMDV

SEQ ID NO: 1649 - DNA, 320 bp, Artificial Sequence
  synthetic
gaaatagtgatgacgcagtctccagccaccctgtctgtgtctccaggggaaagagccaccctctcctgcagggccagtcagagtgttagcagcaacttagcctggtaccagcaaaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcactatattaactggcctctcactttcggcggagggaccaaggtggagatcaa

SEQ ID NO: 1650 - protein, 108 aa, Artificial Sequence
  synthetic
AEIVMTQSPATLSVSPGERATLSCRASQSVSSNLAWYQQKPGQAPRLLIYGASTRATGIPARFSGSGSGTEFTLTISSLQSEDFAVYYCQHYINWPLTFGGGTKVEIK

SEQ ID NO: 1651 - DNA, 18 bp, Artificial Sequence
  synthetic
cagagtgttagcagcaac

SEQ ID NO: 1652 - protein, 6 aa, Artificial Sequence
  synthetic
QSVSSN

SEQ ID NO: 1653 - DNA, 9 bp, Artificial Sequence
  synthetic
ggtgcatcc

SEQ ID NO: 1654 - protein, 3 aa, Artificial Sequence
  synthetic
GAS

SEQ ID NO: 1655 - DNA, 27 bp, Artificial Sequence
  synthetic
cagcactatattaactggcctctcact

SEQ ID NO: 1656 - protein, 9 aa, Artificial Sequence
  synthetic
QHYINWPLT

SEQ ID NO: 1657 - DNA, 369 bp, Artificial Sequence; identical to SEQ ID NO: 401
  synthetic

SEQ ID NO: 1658 - protein, 123 aa, Artificial Sequence; identical to SEQ ID NO: 402
  synthetic

SEQ ID NO: 1659 - DNA, 24 bp, Artificial Sequence
  synthetic
ggattcacctttgatgattttacc

SEQ ID NO: 1660 - protein, 8 aa, Artificial Sequence
  synthetic
GFTFDDFT

SEQ ID NO: 1661 - DNA, 24 bp, Artificial Sequence
  synthetic
atcagttggaatagtggtagcata

SEQ ID NO: 1662 - protein, 8 aa, Artificial Sequence
  synthetic
ISWNSGSI

SEQ ID NO: 1663 - DNA, 48 bp, Artificial Sequence; identical to SEQ ID NO: 407
  synthetic

SEQ ID NO: 1664 - protein, 16 aa, Artificial Sequence
  synthetic
AKDNSGYGYYYYGMDV

SEQ ID NO: 1665 - DNA, 321 bp, Artificial Sequence; identical to SEQ ID NO: 409
  synthetic

SEQ ID NO: 1666 - protein, 107 aa, Artificial Sequence; identical to SEQ ID NO: 410
  synthetic

SEQ ID NO: 1667 - DNA, 18 bp, Artificial Sequence
  synthetic
cacagtgttagcaggaac

SEQ ID NO: 1668 - protein, 6 aa, Artificial Sequence
  synthetic
HSVSRN

SEQ ID NO: 1669 - DNA, 9 bp, Artificial Sequence
  synthetic
ggtgcatcc

SEQ ID NO: 1670 - protein, 3 aa, Artificial Sequence
  synthetic
GAS

SEQ ID NO: 1671 - DNA, 27 bp, Artificial Sequence
  synthetic
cagcagtataataattggcctctcact

SEQ ID NO: 1672 - protein, 9 aa, Artificial Sequence
  synthetic
QQYNNWPLT

SEQ ID NO: 1673 - DNA, 369 bp, Artificial Sequence; identical to SEQ ID NO: 513
  synthetic

SEQ ID NO: 1674 - protein, 123 aa, Artificial Sequence; identical to SEQ ID NO: 514
  synthetic

SEQ ID NO: 1675 - DNA, 24 bp, Artificial Sequence
  synthetic
ggattcacctttgatgattatacc

SEQ ID NO: 1676 - protein, 8 aa, Artificial Sequence
  synthetic
GFTFDDYT

SEQ ID NO: 1677 - DNA, 24 bp, Artificial Sequence
  synthetic
attagttggaatagtggtagtata

SEQ ID NO: 1678 - protein, 8 aa, Artificial Sequence
  synthetic
ISWNSGSI

SEQ ID NO: 1679 - DNA, 48 bp, Artificial Sequence; identical to SEQ ID NO: 519
  synthetic

SEQ ID NO: 1680 - protein, 16 aa, Artificial Sequence
  synthetic
AKDNSGYGHYYYGMDV

SEQ ID NO: 1681 - DNA, 321 bp, Artificial Sequence; identical to SEQ ID NO: 521
  synthetic

SEQ ID NO: 1682 - protein, 107 aa, Artificial Sequence; identical to SEQ ID NO: 522
  synthetic

SEQ ID NO: 1683 - DNA, 18 bp, Artificial Sequence
  synthetic
cagagtgttagcagcaac

SEQ ID NO: 1684 - protein, 6 aa, Artificial Sequence
  synthetic
QSVSSN

SEQ ID NO: 1685 - DNA, 9 bp, Artificial Sequence
  synthetic
ggtgcatcc

SEQ ID NO: 1686 - protein, 3 aa, Artificial Sequence
  synthetic
GAS

SEQ ID NO: 1687 - DNA, 27 bp, Artificial Sequence
  synthetic
cagcactatattaactggcctctcact

SEQ ID NO: 1688 - protein, 9 aa, Artificial Sequence
  synthetic
QHYINWPLT

SEQ ID NO: 1689 - DNA, 354 bp, Artificial Sequence; identical to SEQ ID NO: 577
  synthetic

SEQ ID NO: 1690 - protein, 118 aa, Artificial Sequence; identical to SEQ ID NO: 578
  synthetic

SEQ ID NO: 1691 - DNA, 24 bp, Artificial Sequence
  synthetic
ggatttaccttcagaagttatgcc

SEQ ID NO: 1692 - protein, 8 aa, Artificial Sequence
  synthetic
GFTFRSYA

SEQ ID NO: 1693 - DNA, 24 bp, Artificial Sequence
  synthetic
gtatactatgatggaaataatcaa

SEQ ID NO: 1694 - protein, 8 aa, Artificial Sequence
  synthetic
VYYDGNNQ

SEQ ID NO: 1695 - DNA, 33 bp, Artificial Sequence; identical to SEQ ID NO: 551
  synthetic

SEQ ID NO: 1696 - protein, 11 aa, Artificial Sequence
  synthetic
ARGPGYNWLDP

SEQ ID NO: 1697 - DNA, 321 bp, Artificial Sequence; identical to SEQ ID NO: 585
  synthetic

SEQ ID NO: 1698 - protein, 107 aa, Artificial Sequence; identical to SEQ ID NO: 586
  synthetic

SEQ ID NO: 1699 - DNA, 18 bp, Artificial Sequence
  synthetic
cagagtgttagcaggaac

SEQ ID NO: 1700 - protein, 6 aa, Artificial Sequence
  synthetic
QSVSRN

SEQ ID NO: 1701 - DNA, 9 bp, Artificial Sequence
  synthetic
ggtgcatcc

SEQ ID NO: 1702 - protein, 3 aa, Artificial Sequence
  synthetic
GAS

SEQ ID NO: 1703 - DNA, 27 bp, Artificial Sequence
  synthetic
cagcagtataataactggcctctcact

SEQ ID NO: 1704 - protein, 9 aa, Artificial Sequence
  synthetic
QQYNNWPLT

SEQ ID NO: 1705 - DNA, 354 bp, Artificial Sequence; identical to SEQ ID NO: 561
  synthetic

SEQ ID NO: 1706 - protein, 118 aa, Artificial Sequence; identical to SEQ ID NO: 562
  synthetic

SEQ ID NO: 1707 - DNA, 24 bp, Artificial Sequence
  synthetic
ggattcaccttcagaagttatggc

SEQ ID NO: 1708 - protein, 8 aa, Artificial Sequence
  synthetic
GFTFRSYG

SEQ ID NO: 1709 - DNA, 24 bp, Artificial Sequence
  synthetic
atttactatgatggtaagaataaa

SEQ ID NO: 1710 - protein, 8 aa, Artificial Sequence
  synthetic
IYYDGKNK

SEQ ID NO: 1711 - DNA, 33 bp, Artificial Sequence; identical to SEQ ID NO: 567
  synthetic

SEQ ID NO: 1712 - protein, 11 aa, Artificial Sequence
  synthetic
ARGPGYNWLDP

SEQ ID NO: 1713 - DNA, 321 bp, Artificial Sequence; identical to SEQ ID NO: 569
  synthetic

SEQ ID NO: 1714 - protein, 107 aa, Artificial Sequence; identical to SEQ ID NO: 570
  synthetic

SEQ ID NO: 1715 - DNA, 18 bp, Artificial Sequence
  synthetic
cagagaattagcagcaac

SEQ ID NO: 1716 - protein, 6 aa, Artificial Sequence
  synthetic
QRISSN

SEQ ID NO: 1717 - DNA, 9 bp, Artificial Sequence
  synthetic
ggtgcatcc

SEQ ID NO: 1718 - protein, 3 aa, Artificial Sequence
  synthetic
GAS

SEQ ID NO: 1719 - DNA, 27 bp, Artificial Sequence
  synthetic
cagcaacatcataactggcctctcact

SEQ ID NO: 1720 - protein, 9 aa, Artificial Sequence
  synthetic
QQHHNWPLT

SEQ ID NO: 1721 - protein, 119 aa, Artificial Sequence
  synthetic
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 1722 - protein, 8 aa, Artificial Sequence
  synthetic
GYTFTRYT

SEQ ID NO: 1723 - protein, 8 aa, Artificial Sequence
  synthetic
INPSRGYT

SEQ ID NO: 1724 - protein, 12 aa, Artificial Sequence
  synthetic
ARYYDDHYCLDY

SEQ ID NO: 1725 - protein, 106 aa, Artificial Sequence
  synthetic
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 1726 - protein, 11 aa, Artificial Sequence
  synthetic
LSCRASQSVSY

SEQ ID NO: 1727 - protein, 3 aa, Artificial Sequence
  synthetic
DTS

SEQ ID NO: 1728 - protein, 9 aa, Artificial Sequence
  synthetic
QQWSSNPLT

SEQ ID NO: 1729 - DNA, 372 bp, Artificial Sequence; identical to SEQ ID NO: 1609
  synthetic

SEQ ID NO: 1730 - protein, 124 aa, Artificial Sequence; identical to SEQ ID NO: 1610
  synthetic

SEQ ID NO: 1731 - DNA, 24 bp, Artificial Sequence
  synthetic
gggtttacattcgacgattacagc

SEQ ID NO: 1732 - protein, 8 aa, Artificial Sequence
  synthetic
GFTFDDYS

SEQ ID NO: 1733 - DNA, 24 bp, Artificial Sequence
  synthetic
atatcatggaactcaggaagcaag

SEQ ID NO: 1734 - protein, 8 aa, Artificial Sequence
  synthetic
ISWNSGSK

SEQ ID NO: 1735 - DNA, 51 bp, Artificial Sequence; identical to SEQ ID NO: 1615
  synthetic

SEQ ID NO: 1736 - protein, 17 aa, Artificial Sequence
  synthetic
AKYGSGYGKFYHYGLDV

SEQ ID NO: 1737 - DNA, 372 bp, Artificial Sequence
  synthetic
gaagtacagttggtagaatctggaggaggactcgtgcaaccaggacgatcattgcggttgagttgtgctgctagtggattcacattcgacgactatgctatgcattgggtaagacaggctccaggaaaaggactcgaatgggtgtcaggaataagttggaactccggaagcattgggtacgcagattcagtcaaagggcgattcaccatatcccgagataacgctaagaactcactttaccttcaaatgaactctcttcgagcagaggacactgcactttattattgcgctaaggacggctccggttatggatatttttattattatggaatggacgtatggggacaaggcactactgttaccgttagttcc

SEQ ID NO: 1738 - protein, 124 aa, Artificial Sequence
  synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGSGYGYFYYYGMDVWGQGTTVTVSS

SEQ ID NO: 1739 - DNA, 24 bp, Artificial Sequence
  synthetic
ggattcacattcgacgactatgct

SEQ ID NO: 1740 - protein, 8 aa, Artificial Sequence
  synthetic
GFTFDDYA

SEQ ID NO: 1741 - DNA, 24 bp, Artificial Sequence
  synthetic
ataagttggaactccggaagcatt

SEQ ID NO: 1742 - protein, 8 aa, Artificial Sequence
  synthetic
ISWNSGSI

SEQ ID NO: 1743 - DNA, 51 bp, Artificial Sequence
  synthetic
gctaaggacggctccggttatggatatttttattattatggaatggacgta

SEQ ID NO: 1744 - protein, 17 aa, Artificial Sequence
  synthetic
AKDGSGYGYFYYYGMDV

SEQ ID NO: 1745 - DNA, 372 bp, Artificial Sequence; identical to SEQ ID NO: 1617
  synthetic

SEQ ID NO: 1746 - protein, 124 aa, Artificial Sequence; identical to SEQ ID NO: 1618
  synthetic

SEQ ID NO: 1747 - DNA, 24 bp, Artificial Sequence
  synthetic
ggtttcactttcgacgattatagc

SEQ ID NO: 1748 - protein, 8 aa, Artificial Sequence
  synthetic
GFTFDDYS

SEQ ID NO: 1749 - DNA, 24 bp, Artificial Sequence
  synthetic
attagttggaactcaggaagtatt

SEQ ID NO: 1750 - protein, 8 aa, Artificial Sequence
  synthetic
ISWNSGSI

SEQ ID NO: 1751 - DNA, 51 bp, Artificial Sequence; identical to SEQ ID NO: 1623
  synthetic

SEQ ID NO: 1752 - protein, 17 aa, Artificial Sequence
  synthetic
AKDGSGYGYFYYYGMDV

SEQ ID NO: 1753 - DNA, 372 bp, Artificial Sequence
  synthetic
gaagttcaacttgtggaaagtggcggaggattggttcaaccaggacgttcattgaggctttcatgcgcagcttccggatttacatttgacgattacgcaatgcactgggttagacaggcaccaggaaaaggactggagtgggtgagcgggatttcatggaacagcggcagtatcggttatgcagactcagttaaaggaagattcaccatcagtagagacaacgcaaaaaattccctttatctccaaatgaactctcttagggccgaagatacagcattgtactactgcgcaaaagacggatcaggttacggaaaattttactactatggtatggatgtatggggtcagggaaccacagtaactgtatcaagc

SEQ ID NO: 1754 - protein, 124 aa, Artificial Sequence
  synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGSGYGKFYYYGMDVWGQGTTVTVSS

SEQ ID NO: 1755 - DNA, 24 bp, Artificial Sequence
  synthetic
ggatttacatttgacgattacgca

SEQ ID NO: 1756 - protein, 8 aa, Artificial Sequence
  synthetic
GFTFDDYA

SEQ ID NO: 1757 - DNA, 24 bp, Artificial Sequence
  synthetic
atttcatggaacagcggcagtatc

SEQ ID NO: 1758 - protein, 8 aa, Artificial Sequence
  synthetic
ISWNSGSI

SEQ ID NO: 1759 - DNA, 51 bp, Artificial Sequence
  synthetic
gcaaaagacggatcaggttacggaaaattttactactatggtatggatgta

SEQ ID NO: 1760 - protein, 17 aa, Artificial Sequence
  synthetic
AKDGSGYGKFYYYGMDV

SEQ ID NO: 1761 - DNA, 372 bp, Artificial Sequence; identical to SEQ ID NO: 1625
  synthetic

SEQ ID NO: 1762 - protein, 124 aa, Artificial Sequence; identical to SEQ ID NO: 1626
  synthetic

SEQ ID NO: 1763 - DNA, 24 bp, Artificial Sequence
  synthetic
ggatttacatttgacgactattca

SEQ ID NO: 1764 - protein, 8 aa, Artificial Sequence
  synthetic
GFTFDDYS

SEQ ID NO: 1765 - DNA, 24 bp, Artificial Sequence
  synthetic
atatcttggaactcaggcagtatt

SEQ ID NO: 1766 - protein, 8 aa, Artificial Sequence
  synthetic
ISWNSGSI

SEQ ID NO: 1767 - DNA, 51 bp, Artificial Sequence; identical to SEQ ID NO: 1631
  synthetic

SEQ ID NO: 1768 - protein, 17 aa, Artificial Sequence
  synthetic
AKDGSGYGKFYYYGMDV

SEQ ID NO: 1769 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggactggacgtgtggggacaagggacaacagtgacagtgagtagc

SEQ ID NO: 1770 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYHYGLDVWGQGTTVTVSS

SEQ ID NO: 1771 - DNA, 24 bp, Artificial Sequence
  synthetic
gggtttacattcgacgattacagc

SEQ ID NO: 1772 - protein, 8 aa, Artificial Sequence
  synthetic
GFTFDDYS

SEQ ID NO: 1773 - DNA, 24 bp, Artificial Sequence
  synthetic
atatcatggaactcaggaagcatc

SEQ ID NO: 1774 - protein, 8 aa, Artificial Sequence
  synthetic
ISWNSGSI

SEQ ID NO: 1775 - DNA, 51 bp, Artificial Sequence; identical to SEQ ID NO: 1615
  synthetic

SEQ ID NO: 1776 - protein, 17 aa, Artificial Sequence
  synthetic
AKYGSGYGKFYHYGLDV

SEQ ID NO: 1777 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggactggacgtgtggggacaagggacaacagtgacagtgagtagc

SEQ ID NO: 1778 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYHYGLDVWGQGTTVTVSS

SEQ ID NO: 1779 - DNA, 24 bp, Artificial Sequence
  synthetic
gggtttacattcgacgattacagc

SEQ ID NO: 1780 - protein, 8 aa, Artificial Sequence
  synthetic
GFTFDDYS

SEQ ID NO: 1781 - DNA, 24 bp, Artificial Sequence
  synthetic
atatcatggaactcaggaagcaag

SEQ ID NO: 1782 - protein, 8 aa, Artificial Sequence
  synthetic
ISWNSGSK

SEQ ID NO: 1783 - DNA, 51 bp, Artificial Sequence
  synthetic
gcaaaagacggcagtggttatggcaagttttatcattatggactggacgtg

SEQ ID NO: 1784 - protein, 17 aa, Artificial Sequence
  synthetic
AKDGSGYGKFYHYGLDV

SEQ ID NO: 1785 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggactggacgtgtggggacaagggacaacagtgacagtgagtagc

SEQ ID NO: 1786 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYYYGLDVWGQGTTVTVSS

SEQ ID NO: 1787 - DNA, 24 bp, Artificial Sequence
  synthetic
gggtttacattcgacgattacagc

SEQ ID NO: 1788 - protein, 8 aa, Artificial Sequence
  synthetic
GFTFDDYS

SEQ ID NO: 1789 - DNA, 24 bp, Artificial Sequence
  synthetic
atatcatggaactcaggaagcaag

SEQ ID NO: 1790 - protein, 8 aa, Artificial Sequence
  synthetic
ISWNSGSK

SEQ ID NO: 1791 - DNA, 51 bp, Artificial Sequence
  synthetic
gcaaaatacggcagtggttatggcaagttttattattatggactggacgtg

SEQ ID NO: 1792 - protein, 17 aa, Artificial Sequence
  synthetic
AKYGSGYGKFYYYGLDV

SEQ ID NO: 1793 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggaatggacgtgtggggacaagggacaacagtgacagtgagtagc

SEQ ID NO: 1794 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYHYGMDVWGQGTTVTVSS

SEQ ID NO: 1795 - DNA, 24 bp, Artificial Sequence
  synthetic
gggtttacattcgacgattacagc

SEQ ID NO: 1796 - protein, 8 aa, Artificial Sequence
  synthetic
GFTFDDYS

SEQ ID NO: 1797 - DNA, 24 bp, Artificial Sequence
  synthetic
atatcatggaactcaggaagcaag

SEQ ID NO: 1798 - protein, 8 aa, Artificial Sequence
  synthetic
ISWNSGSK

SEQ ID NO: 1799 - DNA, 51 bp, Artificial Sequence
  synthetic
gcaaaatacggcagtggttatggcaagttttatcattatggaatggacgtg

SEQ ID NO: 1800 - protein, 17 aa, Artificial Sequence
  synthetic
AKYGSGYGKFYHYGMDV

SEQ ID NO: 1801 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggactggacgtgtggggacaagggacaacagtgacagtgagtagc

SEQ ID NO: 1802 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYHYGLDVWGQGTTVTVSS

SEQ ID NO: 1803 - DNA, 24 bp, Artificial Sequence
  synthetic
gggtttacattcgacgattacagc

SEQ ID NO: 1804 - protein, 8 aa, Artificial Sequence
  synthetic
GFTFDDYS

SEQ ID NO: 1805 - DNA, 24 bp, Artificial Sequence
  synthetic
atatcatggaactcaggaagcatc

SEQ ID NO: 1806 - protein, 8 aa, Artificial Sequence
  synthetic
ISWNSGSI

SEQ ID NO: 1807 - DNA, 51 bp, Artificial Sequence; identical to SEQ ID NO: 1783
  synthetic

SEQ ID NO: 1808 - protein, 17 aa, Artificial Sequence
  synthetic
AKDGSGYGKFYHYGLDV

SEQ ID NO: 1809 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggactggacgtgtggggacaagggacaacagtgacagtgagtagc

SEQ ID NO: 1810 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYYYGLDVWGQGTTVTVSS

SEQ ID NO: 1811 - DNA, 24 bp, Artificial Sequence
  synthetic
gggtttacattcgacgattacagc

SEQ ID NO: 1812 - protein, 8 aa, Artificial Sequence
  synthetic
GFTFDDYS

SEQ ID NO: 1813 - DNA, 24 bp, Artificial Sequence
  synthetic
atatcatggaactcaggaagcatc

SEQ ID NO: 1814 - protein, 8 aa, Artificial Sequence
  synthetic
ISWNSGSI

SEQ ID NO: 1815 - DNA, 51 bp, Artificial Sequence; identical to SEQ ID NO: 1791
  synthetic

SEQ ID NO: 1816 - protein, 17 aa, Artificial Sequence
  synthetic
AKYGSGYGKFYYYGLDV

SEQ ID NO: 1817 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttatcattatggaatggacgtgtggggacaagggacaacagtgacagtgagtagc

SEQ ID NO: 1818 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYHYGMDVWGQGTTVTVSS

SEQ ID NO: 1819 - DNA, 24 bp, Artificial Sequence
  synthetic
gggtttacattcgacgattacagc

SEQ ID NO: 1820 - protein, 8 aa, Artificial Sequence
  synthetic
GFTFDDYS

SEQ ID NO: 1821 - DNA, 24 bp, Artificial Sequence
  synthetic
atatcatggaactcaggaagcatc

SEQ ID NO: 1822 - protein, 8 aa, Artificial Sequence
  synthetic
ISWNSGSI

SEQ ID NO: 1823 - DNA, 51 bp, Artificial Sequence; identical to SEQ ID NO: 1799
  synthetic

SEQ ID NO: 1824 - protein, 17 aa, Artificial Sequence
  synthetic
AKYGSGYGKFYHYGMDV

SEQ ID NO: 1825 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggactggacgtgtggggacaagggacaacagtgacagtgagtagc

SEQ ID NO: 1826 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYYYGLDVWGQGTTVTVSS

SEQ ID NO: 1827 - DNA, 24 bp, Artificial Sequence
  synthetic
gggtttacattcgacgattacagc

SEQ ID NO: 1828 - protein, 8 aa, Artificial Sequence
  synthetic
GFTFDDYS

SEQ ID NO: 1829 - DNA, 24 bp, Artificial Sequence
  synthetic
atatcatggaactcaggaagcaag

SEQ ID NO: 1830 - protein, 8 aa, Artificial Sequence
  synthetic
ISWNSGSK

SEQ ID NO: 1831 - DNA, 51 bp, Artificial Sequence
  synthetic
gcaaaagacggcagtggttatggcaagttttattattatggactggacgtg

SEQ ID NO: 1832 - protein, 17 aa, Artificial Sequence
  synthetic
AKDGSGYGKFYYYGLDV

SEQ ID NO: 1833 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggaatggacgtgtggggacaagggacaacagtgacagtgagtagc

SEQ ID NO: 1834 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYHYGMDVWGQGTTVTVSS

SEQ ID NO: 1835 - DNA, 24 bp, Artificial Sequence
  synthetic
gggtttacattcgacgattacagc

SEQ ID NO: 1836 - protein, 8 aa, Artificial Sequence
  synthetic
GFTFDDYS

SEQ ID NO: 1837 - DNA, 24 bp, Artificial Sequence
  synthetic
atatcatggaactcaggaagcaag

SEQ ID NO: 1838 - protein, 8 aa, Artificial Sequence
  synthetic
ISWNSGSK

SEQ ID NO: 1839 - DNA, 51 bp, Artificial Sequence
  synthetic
gcaaaagacggcagtggttatggcaagttttatcattatggaatggacgtg

SEQ ID NO: 1840 - protein, 17 aa, Artificial Sequence
  synthetic
AKDGSGYGKFYHYGMDV

SEQ ID NO: 1841 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggaatggacgtgtggggacaagggacaacagtgacagtgagtagc

SEQ ID NO: 1842 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYYYGMDVWGQGTTVTVSS

SEQ ID NO: 1843 - DNA, 24 bp, Artificial Sequence
  synthetic
gggtttacattcgacgattacagc

SEQ ID NO: 1844 - protein, 8 aa, Artificial Sequence
  synthetic
GFTFDDYS

SEQ ID NO: 1845 - DNA, 24 bp, Artificial Sequence
  synthetic
atatcatggaactcaggaagcaag

SEQ ID NO: 1846 - protein, 8 aa, Artificial Sequence
  synthetic
ISWNSGSK

SEQ ID NO: 1847 - DNA, 51 bp, Artificial Sequence
  synthetic
gcaaaatacggcagtggttatggcaagttttattattatggaatggacgtg

SEQ ID NO: 1848 - protein, 17 aa, Artificial Sequence
  synthetic
AKYGSGYGKFYYYGMDV

SEQ ID NO: 1849 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggactggacgtgtggggacaagggacaacagtgacagtgagtagc

SEQ ID NO: 1850 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYYYGLDVWGQGTTVTVSS

SEQ ID NO: 1851 - DNA, 24 bp, Artificial Sequence
  synthetic
gggtttacattcgacgattacagc

SEQ ID NO: 1852 - protein, 8 aa, Artificial Sequence
  synthetic
GFTFDDYS

SEQ ID NO: 1853 - DNA, 24 bp, Artificial Sequence
  synthetic
atatcatggaactcaggaagcatc

SEQ ID NO: 1854 - protein, 8 aa, Artificial Sequence
  synthetic
ISWNSGSI

SEQ ID NO: 1855 - DNA, 51 bp, Artificial Sequence; identical to SEQ ID NO: 1831
  synthetic

SEQ ID NO: 1856 - protein, 17 aa, Artificial Sequence
  synthetic
AKDGSGYGKFYYYGLDV

SEQ ID NO: 1857 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttatcattatggaatggacgtgtggggacaagggacaacagtgacagtgagtagc

SEQ ID NO: 1858 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKDGSGYGKFYHYGMDVWGQGTTVTVSS

SEQ ID NO: 1859 - DNA, 24 bp, Artificial Sequence
  synthetic
gggtttacattcgacgattacagc

SEQ ID NO: 1860 - protein, 8 aa, Artificial Sequence
  synthetic
GFTFDDYS

SEQ ID NO: 1861 - DNA, 24 bp, Artificial Sequence
  synthetic
atatcatggaactcaggaagcatc

SEQ ID NO: 1862 - protein, 8 aa, Artificial Sequence
  synthetic
ISWNSGSI

SEQ ID NO: 1863 - DNA, 51 bp, Artificial Sequence; identical to SEQ ID NO: 1839
  synthetic

SEQ ID NO: 1864 - protein, 17 aa, Artificial Sequence
  synthetic
AKDGSGYGKFYHYGMDV

SEQ ID NO: 1865 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcatcggatacgccgacagcgtgaaaggccgatttacaatatctagggacaacgcaaaaaactctctctaccttcaaatgaactctcttagggcagaagacacagcattgtattattgcgcaaaatacggcagtggttatggcaagttttattattatggaatggacgtgtggggacaagggacaacagtgacagtgagtagc

SEQ ID NO: 1866 - protein, 124 aa, Artificial Sequence
  synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYYYGMDVWGQGTTVTVSS

SEQ ID NO: 1867 - DNA, 24 bp, Artificial Sequence
  synthetic
gggtttacattcgacgattacagc

SEQ ID NO: 1868 - protein, 8 aa, Artificial Sequence
  synthetic
GFTFDDYS

SEQ ID NO: 1869 - DNA, 24 bp, Artificial Sequence
  synthetic
atatcatggaactcaggaagcatc

SEQ ID NO: 1870 - protein, 8 aa, Artificial Sequence
  synthetic
ISWNSGSI

SEQ ID NO: 1871 - DNA, 51 bp, Artificial Sequence; identical to SEQ ID NO: 1847
  synthetic

SEQ ID NO: 1872 - protein, 17 aa, Artificial Sequence
  synthetic
AKYGSGYGKFYYYGMDV

SEQ ID NO: 1873 - DNA, 372 bp, Artificial Sequence
  synthetic
gaagtacagcttgtagaatccggcggaggactggtacaacctggaagaagtcttagactgagttgcgcagctagtgggtttacattcgacgattacagcatgcattgggtgaggcaagctcctggtaaaggattggaatgggttagcgggatatcatggaactcaggaagcaagggatacgccgacagcgtgaaaggccgatttacaatatctagggacaacgcaaaaaactctctctaccttcaaatgaactctcttagggcagaagacacagcattgtattattgcgcaaaagacggcagtggttatggcaagttttattattatggaatggacgtgtggggacaagggacaacagtgacagtgagtagc

SEQ ID NO: 1874 - protein, 124 aa, Artificial Sequence
  synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKDGSGYGKFYYYGMDVWGQGTTVTVSS

SEQ ID NO: 1875 - DNA, 24 bp, Artificial Sequence
  synthetic
gggtttacattcgacgattacagc

SEQ ID NO: 1876 - protein, 8 aa, Artificial Sequence
  synthetic
GFTFDDYS

SEQ ID NO: 1877 - DNA, 24 bp, Artificial Sequence
  synthetic
atatcatggaactcaggaagcaag

SEQ ID NO: 1878 - protein, 8 aa, Artificial Sequence
  synthetic
ISWNSGSK

SEQ ID NO: 1879 - DNA, 51 bp, Artificial Sequence
  synthetic
gcaaaagacggcagtggttatggcaagttttattattatggaatggacgtg

SEQ ID NO: 1880 - protein, 17 aa, Artificial Sequence
  synthetic
AKDGSGYGKFYYYGMDV

SEQ ID NO: 1881 - DNA, 372 bp, Artificial Sequence
  synthetic
gaagtgcagctggtggagtctgggggaggcttggtacagcctggcaggtccctgagactctcctgtgtagcctctggattcacctttgatgattattccatgcactgggtccggcaagctccagggaagggcctggagtgggtctcaggtattagttggaatagtggtagcaaagactatgcggactctgtgaagggccgattcaccatctccagagacaacgccaagaactccctgtatctgcaaatgaacagtctgagagctgaagacacggccttgtattactgtgcaaaatatggaagtggctacgggaagttctaccactacggtttggacgtctggggccaagggaccacggtcaccgtctcctca

SEQ ID NO: 1882 - protein, 124 aa, Artificial Sequence; identical to SEQ ID NO: 1506
  synthetic

SEQ ID NO: 1883 - DNA, 24 bp, Artificial Sequence
  synthetic
ggattcacctttgatgattattcc

SEQ ID NO: 1884 - protein, 8 aa, Artificial Sequence
  synthetic
GFTFDDYS

SEQ ID NO: 1885 - DNA, 24 bp, Artificial Sequence
  synthetic
attagttggaatagtggtagcaaa

SEQ ID NO: 1886 - protein, 8 aa, Artificial Sequence
  synthetic
ISWNSGSK

SEQ ID NO: 1887 - DNA, 51 bp, Artificial Sequence; identical to SEQ ID NO: 1511
  synthetic

SEQ ID NO: 1888 - protein, 17 aa, Artificial Sequence
  synthetic
AKYGSGYGKFYHYGLDV

SEQ ID NO: 1889 - DNA, 324 bp, Artificial Sequence
  synthetic
gacatccagatgacccagtctccatcctccctgtctgcatctgttggagacagcgtcaccatcacttgccgggcaagtcagagcattaacaactatttaaattggtatcagcagaaaccagggaaagcccctaagctcctgatctatactgcatccagtttgctaagtggggtcccttcaaggttcagtggcagtggatctgggacagatttcactctcaccatcagcggtctgcaccctgaagattttgcaacttacttctgtcaacagagtttcagtacccctccgatcaccttcggccaagggacacgactggacattaaa

SEQ ID NO: 1890 - protein, 108 aa, Artificial Sequence
  synthetic
DIQMTQSPSSLSASVGDSVTITCRASQSINNYLNWYQQKPGKAPKLLIYTASSLLSGVPSRFSGSGSGTDFTLTISGLHPEDFATYFCQQSFSTPPITFGQGTRLDIK

SEQ ID NO: 1891 - DNA, 18 bp, Artificial Sequence
  synthetic
cagagcattaacaactat

SEQ ID NO: 1892 - protein, 6 aa, Artificial Sequence
  synthetic
QSINNY

SEQ ID NO: 1893 - DNA, 9 bp, Artificial Sequence
  synthetic
actgcatcc

SEQ ID NO: 1894 - protein, 3 aa, Artificial Sequence
  synthetic
TAS

SEQ ID NO: 1895 - DNA, 30 bp, Artificial Sequence
  synthetic
caacagagtttcagtacccctccgatcacc

SEQ ID NO: 1896 - protein, 10 aa, Artificial Sequence
  synthetic
QQSFSTPPIT

SEQ ID NO: 1897 - protein, 207 aa, Artificial Sequence
  synthetic
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 1898 - protein, 171 aa, Artificial Sequence
  synthetic
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 1899 - protein, 14507 aa, Artificial Sequence
  synthetic
MLKPSGLPGSSSPTRSLMTGSRSTKATPEMDSGLTGATLSPKTSTGAIVVTEHTLPFTSPDKTLASPTSSVVGRTTQSLGVMSSALPESTSRGMTHSEQRTSPSLSPQVNGTPSRNYPATSMVSGLSSPRTRTSSTEGNFTKEASTYTLTVETTSGPVTEKYTVPTETSTTEGDSTETPWDTRYIPVKITSPMKTFADSTASKENAPVSMTPAETTVTDSHTPGRTNPSFGTLYSSFLDLSPKGTPNSRGETSLELILSTTGYPFSSPEPGSAGHSRISTSAPLSSSASVLDNKISETSIFSGQSLTSPLSPGVPEARASTMPNSAIPFSMTLSNAETSAERVRSTISSLGTPSISTKQTAETILTFHAFAETMDIPSTHIAKTLASEWLGSPGTLGGTSTSALTTTSPSTTLVSEETNTHHSTSGKETEGTLNTSMTPLETSAPGEESEMTATLVPTLGFTTLDSKIRSPSQVSSSHPTRELRTTGSTSGRQSSSTAAHGSSDILRATTSSTSKASSWTSESTAQQFSEPQHTQWVETSPSMKTERPPASTSVAAPITTSVPSVVSGFTTLKTSSTKGIWLEETSADTLIGESTAGPTTHQFAVPTGISMTGGSSTRGSQGTTHLLTRATASSETSADLTLATNGVPVSVSPAVSKTAAGSSPPGGTKPSYTMVSSVIPETSSLQSSAFREGTSLGLTPLNTRHPFSSPEPDSAGHTKISTSIPLLSSASVLEDKVSATSTFSHHKATSSITTGTPEISTKTKPSSAVLSSMTLSNAATSPERVRNATSPLTHPSPSGEETAGSVLTLSTSAETTDSPNIHPTGTLTSESSESPSTLSLPSVSGVKTTFSSSTPSTHLFTSGEETEETSNPSVSQPETSVSRVRTTLASTSVPTPVFPTMDTWPTRSAQFSSSHLVSELRATSSTSVTNSTGSALPKISHLTGTATMSQTNRDTFNDSAAPQSTTWPETSPRFKTGLPSATTTVSTSATSLSATVMVSKFTSPATSSMEATSIREPSTTILTTETTNGPGSMAVASTNIPIGKGYITEGRLDTSHLPIGTTASSETSMDFTMAKESVSMSVSPSQSMDAAGSSTPGRTSQFVDTFSDDVYHLTSREITIPRDGTSSALTPQMTATHPPSPDPGSARSTWLGILSSSPSSPTPKVTMSSTFSTQRVTTSMIMDTVETSRWNMPNLPSTTSLTPSNIPTSGAIGKSTLVPLDTPSPATSLEASEGGLPTLSTYPESTNTPSIHLGAHASSESPSTIKLTMASVVKPGSYTPLTFPSIETHIHVSTARMAYSSGSSPEMTAPGETNTGSTWDPTTYITTTDPKDTSSAQVSTPHSVRTLRTTENHPKTESATPAAYSGSPKISSSPNLTSPATKAWTITDTTEHSTQLHYTKLAEKSSGFETQSAPGPVSVVIPTSPTIGSSTLELTSDVPGEPLVLAPSEQTTITLPMATWLSTSLTEEMASTDLDISSPSSPMSTFAIFPPMSTPSHELSKSEADTSAIRNTDSTTLDQHLGIRSLGRTGDLTTVPITPLTTTWTSVIEHSTQAQDTLSATMSPTHVTQSLKDQTSIPASASPSHLTEVYPELGTQGRSSSEATTFWKPSTDTLSREIETGPTNIQSTPPMDNTTTGSSSSGVTLGIAHLPIGTSSPAETSTNMALERRSSTATVSMAGTMGLLVTSAPGRSISQSLGRVSSVLSESTTEGVTDSSKGSSPRLNTQGNTALSSSLEPSYAEGSQMSTSIPLTSSPTTPDVEFIGGSTFWTKEVTTVMTSDISKSSARTESSSATLMSTALGSTENTGKEKLRTASMDLPSPTPSMEVTPWISLTLSNAPNTTDSLDLSHGVHTSSAGTLATDRSLNTGVTRASRLENGSDTSSKSLSMGNSTHTSMTYTEKSEVSSSIHPRPETSAPGAETTLTSTPGNRAISLTLPFSSIPVEEVISTGITSGPDINSAPMTHSPITPPTIVWTSTGTIEQSTQPLHAVSSEKVSVQTQSTPYVNSVAVSASPTHENSVSSGSSTSSPYSSASLESLDSTISRRNAITSWLWDLTTSLPTTTWPSTSLSEALSSGHSGVSNPSSTTTEFPLFSAASTSAAKQRNPETETHGPQNTAASTLNTDASSVTGLSETPVGASISSEVPLPMAITSRSDVSGLTSESTANPSLGTASSAGTKLTRTISLPTSESLVSFRMNKDPWTVSIPLGSHPTTNTETSIPVNSAGPPGLSTVASDVIDTPSDGAESIPTVSFSPSPDTEVTTISHFPEKTTHSFRTISSLTHELTSRVTPIPGDWMSSAMSTKPTGASPSITLGERRTITSAAPTTSPIVLTASFTETSTVSLDNETTVKTSDILDARKTNELPSDSSSSSDLINTSIASSTMDVTKTASISPTSISGMTASSSPSLFSSDRPQVPTSTTETNTATSPSVSSNTYSLDGGSNVGGTPSTLPPFTITHPVETSSALLAWSRPVRTFSTMVSTDTASGENPTSSNSVVTSVPAPGTWTSVGSTTDLPAMGFLKTSPAGEAHSLLASTIEPATAFTPHLSAAVVTGSSATSEASLLTTSESKAIHSSPQTPTTPTSGANWETSATPESLLVVTETSDTTLTSKILVTDTILFSTVSTPPSKFPSTGTLSGASFPTLLPDTPAIPLTATEPTSSLATSFDSTPLVTIASDSLGTVPETTLTMSETSNGDALVLKTVSNPDRSIPGITIQGVTESPLHPSSTSPSKIVAPRNTTYEGSITVALSTLPAGTTGSLVFSQSSENSETTALVDSSAGLERASVMPLTTGSQGMASSGGIRSGSTHSTGTKTFSSLPLTMNPGEVTAMSEITTNRLTATQSTAPKGIPVKPTSAESGLLTPVSASSSPSKAFASLTTAPPTWGIPQSTLTFEFSEVPSLDTKSASLPTPGQSLNTIPDSDASTASSSLSKSPEKNPRARMMTSTKAISASSFQSTGFTETPEGSASPSMAGHEPRVPTSGTGDPRYASESMSYPDPSKASSAMTSTSLASKLTTLFSTGQAARSGSSSSPISLSTEKETSFLSPTASTSRKTSLFLGPSMARQPNILVHLQTSALTLSPTSTLNMSQEEPPELTSSQTIAEEEGTTAETQTLTFTPSETPTSLLPVSSPTEPTARRKSSPETWASSISVPAKTSLVETTDGTLVTTIKMSSQAAQGNSTWPAPAEETGSSPAGTSPGSPEMSTTLKIMSSKEPSISPEIRSTVRNSPWKTPETTVPMETTVEPVTLQSTALGSGSTSISHLPTGTTSPTKSPTENMLATERVSLSPSPPEAWTNLYSGTPGGTRQSLATMSSVSLESPTARSITGTGQQSSPELVSKTTGMEFSMWHGSTGGTTGDTHVSLSTSSNILEDPVTSPNSVSSLTDKSKHKTETWVSTTAIPSTVLNNKIMAAEQQTSRSVDEAYSSTSSWSDQTSGSDITLGASPDVTNTLYITSTAQTTSLVSLPSGDQGITSLTNPSGGKTSSASSVTSPSIGLETLRANVSAVKSDIAPTAGHLSQTSSPAEVSILDVTTAPTPGISTTITTMGTNSISTTTPNPEVGMSTMDSTPATERRTTSTEHPSTWSSTAASDSWTVTDMTSNLKVARSPGTISTMHTTSFLASSTELDSMSTPHGRITVIGTSLVTPSSDASAVKTETSTSERTLSPSDTTASTPISTFSRVQRMSISVPDILSTSWTPSSTEAEDVPVSMVSTDHASTKTDPNTPLSTFLFDSLSTLDWDTGRSLSSATATTSAPQGATTPQELTLETMISPATSQLPFSIGHITSAVTPAAMARSSGVTFSRPDPTSKKAEQTSTQLPTTTSAHPGQVPRSAATTLDVIPHTAKTPDATFQRQGQTALTTEARATSDSWNEKEKSTPSAPWITEMMNSVSEDTIKEVTSSSSVLRTLNTLDINLESGTTSSPSWKSSPYERIAPSESTTDKEAIHPSTNTVETTGWVTSSEHASHSTIPAHSASSKLTSPVVTTSTREQAIVSMSTTTWPESTRARTEPNSFLTIELRDVSPYMDTSSTTQTSIISSPGSTAITKGPRTEITSSKRISSSFLAQSMRSSDSPSEAITRLSNFPAMTESGGMILAMQTSPPGATSLSAPTLDTSATASWTGTPLATTQRFTYSEKTTLFSKGPEDTSQPSPPSVEETSSSSSLVPIHATTSPSNILLTSQGHSPSSTPPVTSVFLSETSGLGKTTDMSRISLEPGTSLPPNLSSTAGEALSTYEASRDTKAIHHSADTAVTNMEATSSEYSPIPGHTKPSKATSPLVTSHIMGDITSSTSVFGSSETTEIETVSSVNQGLQERSTSQVASSATETSTVITHVSSGDATTHVTKTQATFSSGTSISSPHQFITSTNTFTDVSTNPSTSLIMTESSGVTITTQTGPTGAATQGPYLLDTSTMPYLTETPLAVTPDFMQSEKTTLISKGPKDVSWTSPPSVAETSYPSSLTPFLVTTIPPATSTLQGQHTSSPVSATSVLTSGLVKTTDMLNTSMEPVTNSPQNLNNPSNEILATLAATTDIETIHPSINKAVTNMGTASSAHVLHSTLPVSSEPSTATSPMVPASSMGDALASISIPGSETTDIEGEPTSSLTAGRKENSTLQEMNSTTESNIILSNVSVGAITEATKMEVPSFDATFIPTPAQSTKFPDIFSVASSRLSNSPPMTISTHMTTTQTGSSGATSKIPLALDTSTLETSAGTPSVVTEGFAHSKITTAMNNDVKDVSQTNPPFQDEASSPSSQAPVLVTTLPSSVAFTPQWHSTSSPVSMSSVLTSSLVKTAGKVDTSLETVTSSPQSMSNTLDDISVTSAATTDIETTHPSINTVVTNVGTTGSAFESHSTVSAYPEPSKVTSPNVTTSTMEDTTISRSIPKSSKTTRTETETTSSLTPKLRETSISQEITSSTETSTVPYKELTGATTEVSRTDVTSSSSTSFPGPDQSTVSLDISTETNTRLSTSPIMTESAEITITTQTGPHGATSQDTFTMDPSNTTPQAGIHSAMTHGFSQLDVTTLMSRIPQDVSWTSPPSVDKTSSPSSFLSSPAMTTPSLISSTLPEDKLSSPMTSLLTSGLVKITDILRTRLEPVTSSLPNFSSTSDKILATSKDSKDTKEIFPSINTEETNVKANNSGHESHSPALADSETPKATTQMVITTTVGDPAPSTSMPVHGSSETTNIKREPTYFLTPRLRETSTSQESSFPTDTSFLLSKVPTGTITEVSSTGVNSSSKISTPDHDKSTVPPDTFTGEIPRVFTSSIKTKSAEMTITTQASPPESASHSTLPLDTSTTLSQGGTHSTVTQGFPYSEVTTLMGMGPGNVSWMTTPPVEETSSVSSLMSSPAMTSPSPVSSTSPQSIPSSPLPVTALPTSVLVTTTDVLGTTSPESVTSSPPNLSSITHERPATYKDTAHTEAAMHHSTNTAVTNVGTSGSGHKSQSSVLADSETSKATPLMSTTSTLGDTSVSTSTPNISQTNQIQTEPTASLSPRLRESSTSEKTSSTTETNTAFSYVPTGAITQASRTEISSSRTSISDLDRPTIAPDISTGMITRLFTSPIMTKSAEMTVTTQTTTPGATSQGILPWDTSTTLFQGGTHSTVSQGFPHSEITTLRSRTPGDVSWMTTPPVEETSSGFSLMSPSMTSPSPVSSTSPESIPSSPLPVTALLTSVLVTTTNVLGTTSPEPVTSSPPNLSSPTQERLTTYKDTAHTEAMHASMHTNTAVANVGTSISGHESQSSVPADSHTSKATSPMGITFAMGDTSVSTSTPAFFETRIQTESTSSLIPGLRDTRTSEEINTVTETSTVLSEVPTTTTTEVSRTEVITSSRTTISGPDHSKMSPYISTETITRLSTFPFVTGSTEMAITNQTGPIGTISQATLTLDTSSTASWEGTHSPVTQRFPHSEETTTMSRSTKGVSWQSPPSVEETSSPSSPVPLPAITSHSSLYSAVSGSSPTSALPVTSLLTSGRRKTIDMLDTHSELVTSSLPSASSFSGEILTSEASTNTETIHFSENTAETNMGTTNSMHKLHSSVSIHSQPSGHTPPKVTGSMMEDAIVSTSTPGSPETKNVDRDSTSPLTPELKEDSTALVMNSTTESNTVFSSVSLDAATEVSRAEVTYYDPTFMPASAQSTKSPDISPEASSSHSNSPPLTISTHKTIATQTGPSGVTSLGQLTLDTSTIATSAGTPSARTQDFVDSETTSVMNNDLNDVLKTSPFSAEEANSLSSQAPLLVTTSPSPVTSTLQEHSTSSLVSVTSVPTPTLAKITDMDTNLEPVTRSPQNLRNTLATSEATTDTHTMHPSINTAVANVGTTSSPNEFYFTVSPDSDPYKATSAVVITSTSGDSIVSTSMPRSSAMKKIESETTFSLIFRLRETSTSQKIGSSSDTSTVFDKAFTAATTEVSRTELTSSSRTSIQGTEKPTMSPDTSTRSVTMLSTFAGLTKSEERTIATQTGPHRATSQGTLTWDTSITTSQAGTHSAMTHGFSQLDLSTLTSRVPEYISGTSPPSVEKTSSSSSLLSLPAITSPSPVPTTLPESRPSSPVHLTSLPTSGLVKTTDMLASVASLPPNLGSTSHKIPTTSEDIKDTEKMYPSTNIAVTNVGTTTSEKESYSSVPAYSEPPKVTSPMVTSFNIRDTIVSTSMPGSSEITRIEMESTFSLAHGLKGTSTSQDPIVSTEKSAVLHKLTTGATETSRTEVASSRRTSIPGPDHSTESPDISTEVIPSLPISLGITESSNMTIITRTGPPLGSTSQGTFTLDTPTTSSRAGTHSMATQEFPHSEMTTVMNKDPEILSWTIPPSIEKTSFSSSLMPSPAMTSPPVSSTLPKTIHTTPSPMTSLLTPSLVMTTDTLGTSPEPTTSSPPNLSSTSHEILTTDEDTTAIEAMHPSTSTAATNVETTSSGHGSQSSVLADSEKTKATAPMDTTSTMGHTTVSTSMSVSSETTKIKRESTYSLTPGLRETSISQNASFSTDTSIVLSEVPTGTTAEVSRTEVTSSGRTSIPGPSQSTVLPEISTRTMTRLFASPTMTESAEMTIPTQTGPSGSTSQDTLTLDTSTTKSQAKTHSTLTQRFPHSEMTTLMSRGPGDMSWQSSPSLENPSSLPSLLSLPATTSPPPISSTLPVTISSSPLPVTSLLTSSPVTTTDMLHTSPELVTSSPPKLSHTSDERLTTGKDTTNTEAVHPSTNTAASNVEIPSSGHESPSSALADSETSKATSPMFITSTQEDTTVAISTPHFLETSRIQKESISSLSPKLRETGSSVETSSAIETSAVLSEVSIGATTEISRTEVTSSSRTSISGSAESTMLPEISTTRKIIKFPTSPILAESSEMTIKTQTSPPGSTSESTFTLDTSTTPSLVITHSTMTQRLPHSEITTLVSRGAGDVPRPSSLPVEETSPPSSQLSLSAMISPSPVSSTLPASSHSSSASVTSLLTPGQVKTTEVLDASAEPETSSPPSLSSTSVEILATSEVTTDTEKIHPFSNTAVTKVGTSSSGHESPSSVLPDSETTKATSAMGTISIMGDTSVSTLTPALSNTRKIQSEPASSLTTRLRETSTSEETSLATEANTVLSKVSTGATTEVSRTEAISFSRTSMSGPEQSTMSQDISIGTIPRISASSVLTESAKMTITTQTGPSESTLESTLNLNTATTPSWVETHSIVIQGFPHPEMTTSMGRGPGGVSWPSPPFVKETSPPSSPLSLPAVTSPHPVSTTFLAHIPPSPLPVTSLLTSGPATTTDILGTSTEPGTSSSSSLSTTSHERLTTYKDTAHTEAVHPSTNTGGTNVATTSSGYKSQSSVLADSSPMCTTSTMGDTSVLTSTPAFLETRRIQTELASSLTPGLRESSGSEGTSSGTKMSTVLSKVPTGATTEISKEDVTSIPGPAQSTISPDISTRTVSWFSTSPVMTESAEITMNTHTSPLGATTQGTSTLDTSSTTSLTMTHSTISQGFSHSQMSTLMRRGPEDVSWMSPPLLEKTRPSFSLMSSPATTSPSPVSSTLPESISSSPLPVTSLLTSGLAKTTDMLHKSSEPVTNSPANLSSTSVEILATSEVTTDTEKTHPSSNRTVTDVGTSSSGHESTSFVLADSQTSKVTSPMVITSTMEDTSVSTSTPGFFETSRIQTEPTSSLTLGLRKTSSSEGTSLATEMSTVLSGVPTGATAEVSRTEVTSSSRTSISGFAQLTVSPETSTETITRLPTSSIMTESAEMMIKTQTDPPGSTPESTHTVDISTTPNWVETHSTVTQRFSHSEMTTLVSRSPGDMLWPSQSSVEETSSASSLLSLPATTSPSPVSSTLVEDFPSASLPVTSLLNPGLVITTDRMGISREPGTSSTSNLSSTSHERLTTLEDTVDTEDMQPSTHTAVTNVRTSISGHESQSSVLSDSETPKATSPMGTTYTMGETSVSISTSDFFETSRIQIEPTSSLTSGLRETSSSERISSATEGSTVLSEVPSGATTEVSRTEVISSRGTSMSGPDQFTISPDISTEAITRLSTSPIMTESAESAITIETGSPGATSEGTLTLDTSTTTFWSGTHSTASPGFSHSEMTTLMSRTPGDVPWPSLPSVEEASSVSSSLSSPAMTSTSFFSTLPESISSSPHPVTALLTLGPVKTTDMLRTSSEPETSSPPNLSSTSAEILATSEVTKDREKIHPSSNTPVVNVGTVIYKHLSPSSVLADLVTTKPTSPMATTSTLGNTSVSTSTPAFPETMMTQPTSSLTSGLREISTSQETSSATERSASLSGMPTGATTKVSRTEALSLGRTSTPGPAQSTISPEISTETITRISTPLTTTGSAEMTITPKTGHSGASSQGTFTLDTSSRASWPGTHSAATHRSPHSGMTTPMSRGPEDVSWPSRPSVEKTSPPSSLVSLSAVTSPSPLYSTPSESSHSSPLRVTSLFTPVMMKTTDMLDTSLEPVTTSPPSMNITSDESLATSKATMETEAIQLSENTAVTQMGTISARQEFYSSYPGLPEPSKVTSPVVTSSTIKDIVSTTIPASSEITRIEMESTSTLTPTPRETSTSQEIHSATKPSTVPYKALTSATIEDSMTQVMSSSRGPSPDQSTMSQDISTEVITRLSTSPIKTESTEMTITTQTGSPGATSRGTLTLDTSTTFMSGTHSTASQGFSHSQMTALMSRTPGDVPWLSHPSVEEASSASFSLSSPVMTSSSPVSSTLPDSIHSSSLPVTSLLTSGLVKTTELLGTSSEPETSSPPNLSSTSAEILAITEVTTDTEKLEMTNVVTSGYTHESPSSVLADSVTTKATSSMGITYPTGDTNVLTSTPAFSDTSRIQTKSKLSLTPGLMETSISEETSSATEKSTVLSSVPTGATTEVSRTEAISSSRTSIPGPAQSTMSSDTSMETITRISTPLTRKESTDMAITPKTGPSGATSQGTFTLDSSSTASWPGTHSATTQRFPQSVVTTPMSRGPEDVSWPSPLSVEKNSPPSSLVSSSSVTSPSPLYSTPSGSSHSSPVPVTSLFTSIMMKATDMLDASLEPETTSAPNMNITSDESLAASKATTETEAIHVFENTAASHVETTSATEELYSSSPGFSEPTKVISPVVTSSSIRDNMVSTTMPGSSGITRIEIESMSSLTPGLRETRTSQDITSSTETSTVLYKMPSGATPEVSRTEVMPSSRTSIPGPAQSTMSLDISDEVVTRLSTSPIMTESAEITITTQTGYSLATSQVTLPLGTSMTFLSGTHSTMSQGLSHSEMTNLMSRGPESLSWTSPRFVETTRSSSSLTSLPLTTSLSPVSSTLLDSSPSSPLPVTSLILPGLVKTTEVLDTSSEPKTSSSPNLSSTSVEIPATSEIMTDTEKIHPSSNTAVAKVRTSSSVHESHSSVLADSETTITIPSMGITSAVDDTTVFTSNPAFSETRRIPTEPTFSLTPGFRETSTSEETTSITETSAVLYGVPTSATTEVSMTEIMSSNRIHIPDSDQSTMSPDIITEVITRLSSSSMMSESTQMTITTQKSSPGATAQSTLTLATTTAPLARTHSTVPPRFLHSEMTTLMSRSPENPSWKSSLFVEKTSSSSSLLSLPVTTSPSVSSTLPQSIPSSSFSVTSLLTPGMVKTTDTSTEPGTSLSPNLSGTSVEILAASEVTTDTEKIHPSSSMAVTNVGTTSSGHELYSSVSIHSEPSKATYPVGTPSSMAETSISTSMPANFETTGFEAEPFSHLTSGFRKTNMSLDTSSVTPTNTPSSPGSTHLLQSSKTDFTSSAKTSSPDWPPASQYTEIPVDIITPFNASPSITESTGITSFPESRFTMSVTESTHHLSTDLLPSAETISTGTVMPSLSEAMTSFATTGVPRAISGSGSPFSRTESGPGDATLSTIAESLPSSTPVPFSSSTFTTTDSSTIPALHEITSSSATPYRVDTSLGTESSTTEGRLVMVSTLDTSSQPGRTSSSPILDTRMTESVELGTVTSAYQVPSLSTRLTRTDGIMEHITKIPNEAAHRGTIRPVKGPQTSTSPASPKGLHTGGTKRMETTTTALKTTTTALKTTSRATLTTSVYTPTLGTLTPLNASMQMASTIPTEMMITTPYVFPDVPETTSSLATSLGAETSTALPRTTPSVFNRESETTASLVSRSGAERSPVIQTLDVSSSEPDTTASWVIHPAETIPTVSKTTPNFFHSELDTVSSTATSHGADVSSAIPTNISPSELDALTPLVTISGTDTSTTFPTLTKSPHETETRTTWLTHPAETSSTIPRTIPNFSHHESDATPSIATSPGAETSSAIPIMTVSPGAEDLVTSQVTSSGTDRNMTIPTLTLSPGEPKTIASLVTHPEAQTSSAIPTSTISPAVSRLVTSMVTSLAAKTSTTNRALTNSPGEPATTVSLVTHPAQTSPTVPWTTSIFFHSKSDTTPSMTTSHGAESSSAVPTPTVSTEVPGVVTPLVTSSRAVISTTIPILTLSPGEPETTPSMATSHGEEASSAIPTPTVSPGVPGVVTSLVTSSRAVTSTTIPILTFSLGEPETTPSMATSHGTEAGSAVPTVLPEVPGMVTSLVASSRAVTSTTLPTLTLSPGEPETTPSMATSHGAEASSTVPTVSPEVPGVVTSLVTSSSGVNSTSIPTLILSPGELETTPSMATSHGAEASSAVPTPTVSPGVSGVVTPLVTSSRAVTSTTIPILTLSSSEPETTPSMATSHGVEASSAVLTVSPEVPGMVTSLVTSSRAVTSTTIPTLTISSDEPETTTSLVTHSEAKMISAIPTLAVSPTVQGLVTSLVTSSGSETSAFSNLTVASSQPETIDSWVAHPGTEASSVVPTLTVSTGEPFTNISLVTHPAESSSTLPRTTSRFSHSELDTMPSTVTSPEAESSSAISTTISPGIPGVLTSLVTSSGRDISATFPTVPESPHESEATASWVTHPAVTSTTVPRTTPNYSHSEPDTTPSIATSPGAEATSDFPTITVSPDVPDMVTSQVTSSGTDTSITIPTLTLSSGEPETTTSFITYSETHTSSAIPTLPVSPGASKMLTSLVISSGTDSTTTFPTLTETPYEPETTAIQLIHPAETNTMVPRTTPKFSHSKSDTTLPVAITSPGPEASSAVSTTTISPDMSDLVTSLVPSSGTDTSTTFPTLSETPYEPETTATWLTHPAETSTTVSGTIPNFSHRGSDTAPSMVTSPGVDTRSGVPTTTIPPSIPGVVTSQVTSSATDTSTAIPTLTPSPGEPETTASSATHPGTQTGFTVPIRTVPSSEPDTMASWVTHPPQTSTPVSRTTSSFSHSSPDATPVMATSPRTEASSAVLTTISPGAPEMVTSQITSSGAATSTTVPTLTHSPGMPETTALLSTHPRTETSKTFPASTVFPQVSETTASLTIRPGAETSTALPTQTTSSLFTLLVTGTSRVDLSPTASPGVSAKTAPLSTHPGTETSTMIPTSTLSLGLLETTGLLATSSSAETSTSTLTLTVSPAVSGLSSASITTDKPQTVTSWNTETSPSVTSVGPPEFSRTVTGTTMTLIPSEMPTPPKTSHGEGVSPTTILRTTMVEATNLATTGSSPTVAKTTTTFNTLAGSLFTPLTTPGMSTLASESVTSRTSYNHRSWISTTSSYNRRYWTPATSTPVTSTFSPGISTSSIPSSTAATVPFMVPFTLNFTITNLQYEEDMRHPGSRKFNATERELQGLLKPLFRNSSLEYLYSGCRLASLRPEKDSSATAVDAICTHRPDPEDLGLDRERLYWELSNLTNGIQELGPYTLDRNSLYVNGFTHRSSMPTTSTPGTSTVDVGTSGTPSSSPSPTTAGPLLMPFTLNFTITNLQYEEDMRRTGSRKFNTMESVLQGLLKPLFKNTSVGPLYSGCRLTLLRPEKDGAATGVDAICTHRLDPKSPGLNREQLYWELSKLTNDIEELGPYTLDRNSLYVNGFTHQSSVSTTSTPGTSTVDLRTSGTPSSLSSPTIMAAGPLLVPFTLNFTITNLQYGEDMGHPGSRKFNTTERVLQGLLGPIFKNTSVGPLYSGCRLTSLRSEKDGAATGVDAICIHHLDPKSPGLNRERLYWELSQLTNGIKELGPYTLDRNSLYVNGFTHRTSVPTSSTPGTSTVDLGTSGTPFSLPSPATAGPLLVLFTLNFTITNLKYEEDMHRPGSRKFNTTERVLQTLLGPMFKNTSVGLLYSGCRLTLLRSEKDGAATGVDAICTHRLDPKSPGVDREQLYWELSQLTNGIKELGPYTLDRNSLYVNGFTHWIPVPTSSTPGTSTVDLGSGTPSSLPSPTTAGPLLVPFTLNFTITNLKYEEDMHCPGSRKFNTTERVLQSLLGPMFKNTSVGPLYSGCRLTLLRSEKDGAATGVDAICTHRLDPKSPGVDREQLYWELSQLTNGIKELGPYTLDRNSLYVNGFTHQTSAPNTSTPGTSTVDLGTSGTPSSLPSPTSAGPLLVPFTLNFTITNLQYEEDMHHPGSRKFNTTERVLQGLLGPMFKNTSVGLLYSGCRLTLLRPEKNGAATGMDAICSHRLDPKSPGLNREQLYWELSQLTHGIKELGPYTLDRNSLYVNGFTHRSSVAPTSTPGTSTVDLGTSGTPSSLPSPTTAVPLLVPFTLNFTITNLQYGEDMRHPGSRKFNTTERVLQGLLGPLFKNSSVGPLYSGCRLISLRSEKDGAATGVDAICTHHLNPQSPGLDREQLYWQLSQMTNGIKELGPYTLDRNSLYVNGFTHRSSGLTTSTPWTSTVDLGTSGTPSPVPSPTTTGPLLVPFTLNFTITNLQYEENMGHPGSRKFNITESVLQGLLKPLFKSTSVGPLYSGCRLTLLRPEKDGVATRVDAICTHRPDPKIPGLDRQQLYWELSQLTHSITELGPYTLDRDSLYVNGFTQRSSVPTTSTPGTFTVQPETSETPSSLPGPTATGPVLLPFTLNFTITNLQYEEDMRRPGSRKFNTTERVLQGLLMPLFKNTSVSSLYSGCRLTLLRPEKDGAATRVDAVCTHRPDPKSPGLDRERLYWKLSQLTHGITELGPYTLDRHSLYVNGFTHQSSMTTTRTPDTSTMHLATSRTPASLSGPMTASPLLVLFTINFTITNLRYEENMHHPGSRKFNTTERVLQGLLRPVFKNTSVGPLYSGCRLTLLRPKKDGAATKVDAICTYRPDPKSPGLDREQLYWELSQLTHSITELGPYTLDRDSLYVNGFTQRSSVPTTSIPGTPTVDLGTSGTPVSKPGPSAASPLLVLFTLNFTITNLRYEENMQHPGSRKFNTTERVLQGLLRSLFKSTSVGPLYSGCRLTLLRPEKDGTATGVDAICTHHPDPKSPRLDREQLYWELSQLTHNITELGPYALDNDSLFVNGFTHRSSVSTTSTPGTPTVYLGASKTPASIFGPSAASHLLILFTLNFTITNLRYEENMWPGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPFWAVILIGLAGLLGVITCLICGVLVTTRRRKKEGEYNVQQQCPGYYQSHLDLEDLQ

SEQ ID NO: 1900 - protein, 207 aa, Artificial Sequence; identical to SEQ ID NO: 1897
  synthetic

SEQ ID NO: 1901 - protein, 171 aa, Artificial Sequence; identical to SEQ ID NO: 1898
  synthetic

SEQ ID NO: 1902 - protein, 670 aa, Artificial Sequence
  synthetic
PGSRKFNTTERVLQGLLRPLFKNTSVGPLYSGCRLTLLRPEKDGEATGVDAICTHRPDPTGPGLDREQLYLELSQLTHSITELGPYTLDRDSLYVNGFTHRSSVPTTSTGVVSEEPFTLNFTINNLRYMADMGQPGSLKFNITDNVMQHLLSPLFQRSSLGARYTGCRVIALRSVKNGAETRVDLLCTYLQPLSGPGLPIKQVFHELSQQTHGITRLGPYSLDKDSLYLNGYNEPGPDEPPTTPKPATTFLPPLSEATTAMGYHLKTLTLNFTISNLQYSPDMGKGSATFNSTEGVLQHLLRPLFQKSSMGPFYLGCQLISLRPEKDGAATGVDTTCTYHPDPVGPGLDIQQLYWELSQLTHGVTQLGFYVLDRDSLFINGYAPQNLSIRGEYQINFHIVNWNLSNPDPTSSEYITLLRDIQDKVTTLYKGSQLHDTFRFCLVTNLTMDSVLVTVKALFSSNLDPSLVEQVFLDKTLNASFHWLGSTYQLVDIHVTEMESSVYQPTSSSSTQHFYLNFTITNLPYSQDKAQPGTTNYQRNKRNIEDALNQLFRNSSIKSYFSDCQVSTFRSVPNRHHTGVDSLCNFSPLARRVDRVAIYEEFLRMTRNGTQLQNFTLDRSSVLVDGYSPNRNEPLTGNSDLPEQKLISEEDLGGEQKLISEEDLHHHHHH

SEQ ID NO: 1903 - protein, 25 aa, Artificial Sequence [sequence omitted]

SEQ ID NO: 1904 - protein, 17 aa, Artificial Sequence
  synthetic
MHWVRQAPGKGLEWVSG

SEQ ID NO: 1905 - protein, 38 aa, Artificial Sequence
  synthetic
GYADSVKGRFTISRDNAKNSLYLQMNSLRAEDTALYYC

SEQ ID NO: 1906 - protein, 11 aa, Artificial Sequence
  synthetic
WGQGTTVTVSS

SEQ ID NO: 1907 - protein, 8 aa, Artificial Sequence
  synthetic
  VARIANT (8)..(8): Xaa = Any Amino Acid
GFTFDDYX

SEQ ID NO: 1908 - protein, 8 aa, Artificial Sequence
  synthetic
  VARIANT (8)..(8): Xaa = Any Amino Acid
ISWNSGSX

SEQ ID NO: 1909 - protein, 17 aa, Artificial Sequence
  synthetic
  VARIANT (3)..(3): Xaa = Any Amino Acid
  VARIANT (12)..(12): Xaa = Any Amino Acid
  VARIANT (15)..(15): Xaa = Any Amino Acid
AKXGSGYGKFYXYGXDV

SEQ ID NO: 1910 - protein, 125 aa, Artificial Sequence
  synthetic
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDGYSGYGYFYYYGMDVWGQGTTVTVSS

SEQ ID NO: 1911 - protein, 330 aa, Artificial Sequence [sequence omitted]

SEQ ID NO: 1912 - protein, 330 aa, Artificial Sequence
  synthetic
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1913 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 1914 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNRFTQKSLSLSPGK

SEQ ID NO: 1915 - protein, 327 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1916 - protein, 327 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1917 - protein, 329 aa, Artificial Sequence
  synthetic
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1918 - protein, 329 aa, Artificial Sequence
  synthetic
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1919 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1920 - protein, 326 aa, Artificial Sequence
  synthetic
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1921 - protein, 232 aa, Artificial Sequence
  synthetic
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1922 - protein, 232 aa, Artificial Sequence
  synthetic
EPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1923 - protein, 228 aa, Artificial Sequence
  synthetic
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNHYTQKSLSLSPGK

SEQ ID NO: 1924 - protein, 228 aa, Artificial Sequence
  synthetic
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDISVEWESNGQPENNYKTTPPMLDSDGSFFLYSKLTVDKSRWQQGNVFSCSVMHEALHNRFTQKSLSLSPGK

SEQ ID NO: 1925 - protein, 229 aa, Artificial Sequence
  synthetic
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1926 - protein, 229 aa, Artificial Sequence
  synthetic
ESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1927 - protein, 231 aa, Artificial Sequence
  synthetic
EPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1928 - protein, 231 aa, Artificial Sequence
  synthetic
EPKSCDKTHTCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1929 - protein, 228 aa, Artificial Sequence
  synthetic
ESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1930 - protein, 228 aa, Artificial Sequence
  synthetic
ESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSLGK

SEQ ID NO: 1931 - protein, 227 aa, Artificial Sequence
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNRFTQKSLSLSPGK

SEQ ID NO: 1932 - protein, 227 aa, Artificial Sequence
  synthetic
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1933 - protein, 233 aa, Artificial Sequence
  synthetic
EPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNRFTTKSFSRTPGK

SEQ ID NO: 1934 - protein, 233 aa, Artificial Sequence
  synthetic
EPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 1935 - DNA, 324 bp, Artificial Sequence; identical to SEQ ID NO: 169
  synthetic

SEQ ID NO: 1936 - protein, 108 aa, Artificial Sequence; identical to SEQ ID NO: 170
  synthetic

SEQ ID NO: 1937 - DNA, 21 bp, Artificial Sequence
  synthetic
cagagtgttagcagcagctac

SEQ ID NO: 1938 - protein, 7 aa, Artificial Sequence
  synthetic
QSVSSSY

SEQ ID NO: 1939 - DNA, 9 bp, Artificial Sequence
  synthetic
ggtgcatcc

SEQ ID NO: 1940 - protein, 3 aa, Artificial Sequence
  synthetic
GAS

SEQ ID NO: 1941 - DNA, 27 bp, Artificial Sequence
  synthetic
cagcagtatggtagctcaccttggacg

SEQ ID NO: 1942 - protein, 9 aa, Artificial Sequence
  synthetic
QQYGSSPWT

SEQ ID NO: 1943 - DNA, 357 bp, Artificial Sequence
  Synthetic
caggtgcagctacagcagtggggcgcaggactgttgaagccctcggagaccctgtccctcacctgcgctgtctatggtgggtccttcagtggtttctactggagctggatccgccagtccccagggaaggggctggagtggataggggaaatcaatcgtggtggaagcaccaactccaacccgtccctcaagagtcgagtcaccatgtcactagacacgtccaaaacccagttctccctgaagctgaggtctgtgaccgccgcggacacggctatatattattgtgcgagaagtctggaactagactctgatggttttgatatctggggccaagggacaatggtcaccgtctcttca

SEQ ID NO: 1944 - protein, 119 aa, Artificial Sequence
  Synthetic
QVQLQQWGAGLLKPSETLSLTCAVYGGSFSGFYWSWIRQSPGKGLEWIGEINRGGSTNSNPSLKSRVTMSLDTSKTQFSLKLRSVTAADTAIYYCARSLELDSDGFDIWGQGTMVTVSS

SEQ ID NO: 1945 - DNA, 24 bp, Artificial Sequence
  Synthetic
ggtgggtccttcagtggtttctac

SEQ ID NO: 1946 - protein, 8 aa, Artificial Sequence
  Synthetic
GGSFSGFY

SEQ ID NO: 1947 - DNA, 21 bp, Artificial Sequence
  Synthetic
atcaatcgtggtggaagcacc

SEQ ID NO: 1948 - protein, 7 aa, Artificial Sequence
  Synthetic
INRGGST

SEQ ID NO: 1949 - DNA, 39 bp, Artificial Sequence
  Synthetic
gcgagaagtctggaactagactctgatggttttgatatc

SEQ ID NO: 1950 - protein, 13 aa, Artificial Sequence
  Synthetic
ARSLELDSDGFDI

SEQ ID NO: 1951 - DNA, 324 bp, Artificial Sequence
  Synthetic
gaaactgtgttgacgcagtctccaggcaccctgtctttgtctccaggggaaagagccaccctctcctgcagggccagtcagagtgttagcagcagctacgtagcctggtaccagcagaaacctggccaggctcccaggcgcctcatctatggtgcatccagcagggccactggcatcccaggcaggttcagtggcagtgggtctgggacagactttactctcaccatcagcagactggagcctgaagattttgcagtgtattactgtcagcagtatggtagttcaccttggacgttcggccaagggaccaaggtggaaatcaaa

SEQ ID NO: 1952 - protein, 108 aa, Artificial Sequence
  Synthetic
ETVLTQSPGTLSLSPGERATLSCRASQSVSSSYVAWYQQKPGQAPRRLIYGASSRATGIPGRFSGSGSGTDFTLTISRLEPEDFAVYYCQQYGSSPWTFGQGTKVEIK

SEQ ID NO: 1953 - DNA, 21 bp, Artificial Sequence
  Synthetic
cagagtgttagcagcagctac

SEQ ID NO: 1954 - protein, 7 aa, Artificial Sequence
  Synthetic
QSVSSSY

SEQ ID NO: 1955 - DNA, 9 bp, Artificial Sequence
  Synthetic
ggtgcatcc

SEQ ID NO: 1956 - protein, 3 aa, Artificial Sequence
  Synthetic
GAS

SEQ ID NO: 1957 - DNA, 21 bp, Artificial Sequence
  Synthetic
cagagtgttagcagcagctac

SEQ ID NO: 1958 - protein, 9 aa, Artificial Sequence
  Synthetic
QQYGSSPWT

SEQ ID NO: 1959 - protein, 443 aa, Artificial Sequence
  Synthetic
QVQLVESGGGLVKPGGSLRLSCAASGFTFSNYYMSWVRQAPGKGLEWISYISGRGSTIFYADSVKGRITISRDNAKNSLFLQMNSLRAEDTAVYFCVKDRGGYSPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1960 - protein, 215 aa, Artificial Sequence
  Synthetic
DIQMTQSPSSLSASVGDRVTITCRASQSISTYLNWYQQKPGKAPKLLIYTASSLQSGVPSRFSGSGSGTDFTLTISSLQPEDFATYYCQQSYSTPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1961 - protein, 450 aa, Artificial Sequence
  Synthetic
EVQLVESGGGLVQPGRSLRLSCAASGFTFDDYSMHWVRQAPGKGLEWVSGISWNSGSKGYADSVKGRFTISRDNAKNSLYLQMNSLRAEDTALYYCAKYGSGYGKFYHYGLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSPGK

SEQ ID NO: 1962 - protein, 450 aa, Artificial Sequence
  Synthetic
EVQLVESGGGLVQPGRSLRLSCAASGFTFDDYSMHWVRQAPGKGLEWVSGISWNSGSIGYADSVKGRFTISRDNAKNSLYLQMNSLRAEDTALYYCAKYGSGYGKFYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNRFTQKSLSLSPGK

What is claimed is:

1. A bispecific antigen-binding molecule comprising a first antigen-binding domain that specifically binds human CD3, and a second antigen-binding domain that specifically binds human MUC16, wherein the second antigen-binding domain comprises: (a) the complementarity determining regions (CDRs) of a heavy chain variable region (HCVR) comprising an amino acid sequence selected from the group consisting of SEQ ID NOs: 2, 18, 34, 50, 66, 82, 98, 114, 130, 146, 162, 178, 194, 202, 218, 234, 250, 258, 274, 282, 298, 314, 330, 346, 362, and 378; and (b) the CDRs of a light chain variable region (LCVR) comprising an amino acid sequence selected from the group consisting of SEQ ID NOs: 10, 26, 42, 58, 74, 90, 106, 122, 138, 154, 170, 186, 210, 226, 242, 266, 290, 306, 322, 338, 354, 370, 386, 394, 858, and 1936.

2. A bispecific antibody, comprising a first binding arm that binds human CD3 and a second binding arm that binds human MUC16, wherein the first binding arm comprises a heavy chain comprising the amino acid sequence of SEQ ID NO: 1961 and a light chain comprising the amino acid sequence of SEQ ID NO: 1960, and wherein the second binding arm comprises a heavy chain comprising the amino acid sequence of SEQ ID NO: 1959 and a light chain comprising the amino acid sequence of SEQ ID NO: 1960.

3. A bispecific antibody, comprising a first binding arm that binds human CD3 and a second binding arm that binds human MUC16, wherein the first binding arm comprises a heavy chain comprising the amino acid sequence of SEQ ID NO: 1962 and a light chain comprising the amino acid sequence of SEQ ID NO: 1960, and wherein the second binding arm comprises a heavy chain comprising the amino acid sequence of SEQ ID NO: 1959 and a light chain comprising the amino acid sequence of SEQ ID NO: 1960.

4. The bispecific antigen-binding molecule of claim 1, wherein the second antigen-binding domain binds human mucin 16 (MUC16) with a binding dissociation equilibrium constant ($K_D$) value of less than about 53 nM as measured in a surface plasmon resonance assay at 25° C.

5. The bispecific antigen-binding molecule of claim 1, wherein the second-antigen-binding domain binds human MUC16 with a dissociative half-life (t½) of greater than about 15 minutes as measured in a surface plasmon resonance assay at 25° C.

6. The bispecific antigen-binding molecule of claim 1, wherein the second antigen-binding domain comprises the heavy and light chain CDRs of a HCVR/LCVR amino acid sequence pair selected from the group consisting of: SEQ ID NOs: 2/10; 18/26; 34/42; 50/58; 66/74; 82/90; 82/858; 98/106; 114/122; 130/138; 146/154; 162/170; 178/186; 194/394; 202/210; 218/226; 234/242; 250/1936; 258/266; 274/1936; 282/290; 298/306; 314/322; 330/338; 346/354; 362/370; and 378/386.

7. The bispecific antigen-binding molecule of claim 6, wherein the second antigen-binding domain comprises HCDR1-HCDR2-HCDR3-LCDR1-LCDR2-LCDR3 domains, respectively, selected from the group consisting of: SEQ ID NOs: 4-6-8-12-14-16; 20-22-24-28-30-32; 36-38-40-44-46-48; 52-54-56-60-62-64; 68-70-72-76-78-80; 84-86-88-92-94-96; 84-86-88-860-862-864; 100-102-104-108-110-112; 100-102-104-172-174-176; 116-118-120-124-126-128; 132-134-136-140-142-144; 148-150-152-156-158-160; 164-166-168-172-174-176; 180-182-184-188-190-192; 196-198-200-396-398-400; 204-206-208-212-214-216; 220-222-224-228-230-232; 236-238-240-244-246-248; 252-254-256-1938-1940-1942; 260-262-264-268-270-272; 276-278-280-1938-1940-1942; 284-286-288-292-294-296; 300-302-304-308-310-312; 316-318-320-324-326-328; 332-334-336-340-342-344; 348-350-352-356-358-360; 364-366-368-372-374-376; and 380-382-384-388-390-392.

8. The bispecific antigen-binding molecule of claim 1, wherein the second antigen-binding domain comprises: (a) a heavy chain variable region (HCVR) comprising an amino acid sequence selected from the group consisting of SEQ ID NOs: 2, 18, 34, 50, 66, 82, 98, 114, 130, 146, 162, 178, 194, 202, 218, 234, 250, 258, 274, 282, 298, 314, 330, 346, 362, and 378; and (b) a light chain variable region (LCVR) comprising an amino acid sequence selected from the group consisting of SEQ ID NOs: 10, 26, 42, 58, 74, 90, 106, 122, 138, 154, 170, 186, 210, 226, 242, 266, 290, 306, 322, 338, 354, 370, 386, 394, 858, and 1936.

9. The bispecific antigen-binding molecule of claim 8, wherein the second antigen-binding domain comprises a HCVR/LCVR amino acid sequence pair selected from the group consisting of: SEQ ID NOs: 2/10; 18/26; 34/42; 50/58, 66/74; 82/90; 82/858; 98/106; 114/122; 130/138; 146/154; 162/170; 178/186; 194/394; 202/210; 218/226; 234/242; 250/1936; 258/266; 274/1936; 282/290; 298/306; 314/322; 330/338; 346/354; 362/370; and 378/386.

10. The bispecific antigen-binding molecule of claim 1, wherein the first antigen-binding domain binds human cells expressing human CD3 and cynomolgus monkey cells expressing cynomolgus CD3.

11. The bispecific antigen-binding molecule of claim 1, wherein the antigen-binding molecule binds both human CD3 and human MUC16 and induces T cell-mediated cell killing of MUC16-expressing cells.

12. The bispecific antigen-binding molecule of claim 1, wherein the antigen-binding molecule inhibits tumor growth in immunocompromised mice bearing human ovarian cancer xenografts.

13. The bispecific antigen-binding molecule of claim 1, wherein the antigen-binding molecule suppresses tumor growth of established tumors in immunocompromised mice bearing human ovarian cancer xenografts.

14. The bispecific antigen-binding molecule of claim 1, wherein the antigen-binding molecule induces T cell-mediated tumor cell killing with an $EC_{50}$ value of less than about 31 pM, as measured in an in vitro T cell-mediated tumor cell killing assay.

15. The bispecific antigen-binding molecule of claim 1, wherein the second antigen-binding domain specifically binds human MUC16 with a $K_D$ value of less than about 7 nM, as measured in an in vitro surface plasmon resonance binding assay.

16. The bispecific antigen-binding molecule of claim 1, wherein the second antigen-binding domain specifically binds human MUC16 with a $K_D$ value of less than about 5 nM, less than about 2 nM, less than about 1 nM, less than about 800 pM, or less than about 600 pM, as measured in an in vitro surface plasmon resonance binding assay.

17. The bispecific antigen-binding molecule of claim 1 that is a bispecific antibody or bispecific antigen-binding fragment thereof.

18. The bispecific antigen-binding molecule of claim 1, wherein the second antigen-binding domain that specifically binds human MUC16 comprises three heavy chain complementarity determining regions (A2-HCDR1, A2-HCDR2 and A2-HCDR3) and three light chain complementarity determining regions (A2-LCDR1, A2-LCDR2 and A2-LCDR3), wherein A2-HCDR1 comprises an amino acid sequence selected from the group consisting of SEQ ID NOs: 4, 20, 36, 52, 68, 84, 100, 116, 132, 148, 164, 180, 196, 204, 220, 236, 252, 260, 276, 284, 300, 316, 332, 348, 364, and 380; A2-HCDR2 comprises an amino acid sequence selected from the group consisting of SEQ ID NOs: 6, 22, 38, 54, 70, 86, 102, 118, 134, 150, 166, 182, 198, 206, 222, 238, 254, 262, 278, 286, 302, 318, 334, 350, 366, and 382; A2-HCDR3 comprises an amino acid sequence selected from the group consisting of SEQ ID NOs: 8, 24, 40, 56, 72, 88, 104, 120, 136, 152, 168, 184, 200, 208, 224, 240, 256, 264, 280, 288, 304, 320, 336, 352, 368, and 384; A2-LCDR1 comprises an amino acid sequence selected from the group consisting of SEQ ID NOs: 12, 28, 44, 60, 76, 92, 108, 124, 140, 156, 172, 188, 212, 228, 244, 268, 292, 308, 324, 340, 356, 372, 388, 396, 860, and 1938; A2-LCDR2 comprises an amino acid sequence selected from the group consisting of SEQ ID NOs: 14, 30, 46, 62, 78, 94, 110, 126, 142, 158, 174, 190, 214, 230, 246, 270, 294, 310, 326, 342, 358, 374, 390, 398, 862, and 1940; and A2-LCDR3 comprises an amino acid sequence selected from the group consisting of SEQ ID NOs: 16, 32, 48, 64, 80, 96, 112, 128, 144, 160, 176, 192, 216, 232, 248, 272, 296, 312, 328, 344, 360, 376, 392, 400, 864, and 1942.

19. The bispecific antigen-binding molecule of claim 1, wherein the second antigen-binding domain that specifically binds human MUC16 comprises the heavy and light chain CDRs of a HCVR/LCVR amino acid sequence pair comprising SEQ ID NOs: 18/26.

20. The bispecific antigen-binding molecule of claim 1, wherein the first antigen-binding domain that specifically binds human CD3 comprises heavy chain complementarity determining regions (HCDR1, HCDR2 and HCDR3) from a heavy chain variable region (HCVR) comprising an amino acid sequence selected from the group consisting of SEQ ID NOs: 402, 418, 434, 450, 466, 482, 498, 514, 530, 546, 562, 578, 594, 610, 626, 642, 658, 674, 690, 706, 722, 738, 754, 770, 786, 802, 818, 834, 850, 866, 882, 898, 914, 930, 946, 962, 978, 994, 1010, 1026, 1042, 1058, 1074, 1090, 1106, 1122, 1138, 1154, 1170, 1186, 1202, 1218, 1234, 1250, 1266, 1282, 1298, 1314, 1330, 1346, 1362, 1378, 1394, 1410, 1426, 1442, 1450, 1458, 1466, 1474, 1482, 1490, 1498, 1506, 1514, 1522, 1530, 1538, 1546, 1554, 1562, 1570, 1578, 1586, 1594, 1602, 1610, 1618, 1626, 1642, 1658, 1674, 1690, 1706, 1730, 1738, 1746, 1754, 1762, 1770, 1778, 1786, 1794, 1802, 1810, 1818, 1826, 1834, 1842, 1850, 1858, 1866, 1874, and 1882; and light chain complementarity determining regions (LCDR1, LCDR2 and LCDR3) from a light chain variable region (LCVR) comprising an amino acid sequence selected from the group consisting of SEQ ID NOs: 10, 26, 42, 58, 74, 90, 106, 122, 138, 154, 170, 186, 210, 226, 242, 266, 290, 306, 322, 338, 354, 370, 386, 394, 410, 426, 442, 458, 474, 490, 506, 522, 538, 554, 570, 586, 602, 618, 634, 650, 666, 682, 698, 714, 730, 746, 762, 778, 794, 810, 826, 842, 858, 874, 890, 906, 922, 938, 954, 970, 986, 1002, 1018, 1034, 1050, 1066, 1082, 1098, 1114, 1130, 1146, 1162, 1178, 1194, 1210, 1226, 1242, 1258, 1274, 1290, 1306, 1322, 1338, 1354, 1370, 1386, 1402, 1418, 1434, 1634, 1650, 1666, 1682, 1698, 1714, 1890, and 1936.

21. The bispecific antigen-binding molecule of claim 1, wherein the first antigen-binding domain that specifically binds human CD3 comprises heavy chain complementarity determining regions (HCDR1, HCDR2 and HCDR3) from a heavy chain variable region (HCVR) comprising an amino acid sequence selected from the group consisting of SEQ ID NOs: 1730, 1762, 1778, 1786, and 1866, and light chain complementarity determining regions (LCDR1, LCDR2 and LCDR3) from a light chain variable region (LCVR) comprising the amino acid sequence of SEQ ID NO: 26.

22. The bispecific antigen-binding molecule of claim 1, wherein the first antigen-binding domain that specifically binds human CD3 comprises three heavy chain complementarity determining regions (A1-HCDR1, A1-HCDR2 and A1-HCDR3) and three light chain complementarity determining regions (A1-LCDR1, A1-LCDR2 and A1-LCDR3), wherein A1-HCDR1 comprises an amino acid sequence selected from the group consisting of SEQ ID NOs: 1732, 1764, 1780, 1788, and 1868; A1-HCDR2 comprises an amino acid sequence selected from the group consisting of SEQ ID NOs: 1734, 1766, 1782, 1790, and 1870; A1-HCDR3 comprises an amino acid sequence selected from the group consisting of SEQ ID NOs: 1736, 1768, 1784, 1792, and 1872; A1-LCDR1 comprises the amino acid sequence of SEQ ID NO: 28; A1-LCDR2 comprises the amino acid sequence of SEQ ID NO: 30; and A1-LCDR3 comprises the amino acid sequence of SEQ ID NO: 32.

23. The bispecific antigen-binding molecule of claim 1, wherein the first antigen-binding domain that specifically binds human CD3 comprises the heavy and light chain CDRs of a HCVR/LCVR amino acid sequence pair selected from the group consisting of: SEQ ID NOs: 1730/26, 1762/26, 1778/26, 1786/26, and 1866/26.

24. The bispecific antigen-binding molecule of claim 1, wherein the first antigen-binding domain that specifically binds human CD3 comprises three heavy chain complementarity determining regions (A1-HCDR1, A1-HCDR2 and A1-HCDR3) and three light chain complementarity determining regions (A1-LCDR1, A1-LCDR2 and A1-LCDR3), and wherein the second antigen-binding domain that specifically binds human MUC16 comprises three heavy chain complementarity determining regions (A2-HCDR1, A2-HCDR2 and A2-HCDR3) and three light chain complementarity determining regions (A2-LCDR1, A2-LCDR2 and A2-LCDR3);
wherein A1-HCDR1 comprises an amino acid sequence selected from the group consisting of SEQ ID NOs: 1732, 1764, 1780, 1788, and 1868; A1-HCDR2 comprises an amino acid sequence selected from the group consisting of SEQ ID NOs: 1734, 1766, 1782, 1790, and 1870; A1-HCDR3 comprises an amino acid sequence selected from the group consisting of SEQ ID NOs: 1736, 1768, 1784, 1792, and 1872; A1-LCDR1 comprises the amino acid sequence of SEQ ID NO: 28; A1-LCDR2 comprises the amino acid sequence of SEQ ID NO: 30; and A1-LCDR3 comprises the amino acid sequence of SEQ ID NO: 32; and wherein A2-HCDR1 comprises the amino acid sequence of SEQ ID NO: 20; A2-HCDR2 comprises the amino acid sequence of SEQ ID NO: 22; A2-HCDR3 comprises the amino acid sequence of SEQ ID NO: 24; A2-LCDR1 comprises the amino acid sequence of SEQ ID NO: 28; A2-LCDR2 comprises the amino acid sequence of SEQ ID NO: 30; and A2-LCDR3 comprises the amino acid sequence of SEQ ID NO: 32.

25. The bispecific antigen-binding molecule of claim 1, wherein the first antigen-binding domain that specifically binds human CD3 comprises a heavy chain comprising variable domain framework regions having an amino acid sequence selected from FR1 (SEQ ID NO: 1903), FR2 (SEQ ID NO: 1904), FR3 (SEQ ID NO: 1905), and FR4 (SEQ ID NO: 1906).

26. The bispecific antigen-binding molecule of claim 1, wherein the first antigen-binding domain that specifically binds human CD3 comprises a HCVR comprising HCDR1-HCDR2-HCDR3 comprising the amino acid sequences of SEQ ID NOs: 1907-1908-1909.

27. The bispecific antigen-binding molecule of claim 1, wherein the second antigen-binding domain comprises three heavy chain complementarity determining regions (A2-HCDR1, A2-HCDR2 and A2-HCDR3) and three light chain complementarity determining regions (A2-LCDR1, A2-LCDR2 and A2-LCDR3), wherein A2-HCDR1 comprises the amino acid sequence of SEQ ID NO: 20; A2-HCDR2 comprises the amino acid sequence of SEQ ID NO: 22; A2-HCDR3 comprises the amino acid sequence of SEQ ID NO: 24; A2-LCDR1 comprises the amino acid sequence of SEQ ID NO: 28; A2-LCDR2 comprises the amino acid sequence of SEQ ID NO: 30; and A2-LCDR3 comprises the amino acid sequence of SEQ ID NO: 32.

28. The bispecific antigen-binding molecule of claim 1, wherein the second antigen-binding domain comprises a heavy chain variable region (HCVR) comprising the amino acid sequence of SEQ ID NO: 18, and a light chain variable region (LCVR) comprising the amino acid sequence of SEQ ID NO: 26.

29. The bispecific antigen-binding molecule of claim 1, wherein the first antigen-binding domain comprises a heavy chain variable region (HCVR) comprising an amino acid sequence selected from the group consisting of SEQ ID NOs: 1730, 1762, 1778, 1786, and 1866, and a light chain variable region (LCVR) comprising the amino acid sequence of SEQ ID NO: 26.

30. The bispecific antigen-binding molecule of claim 1, wherein the first antigen-binding domain comprises a heavy chain variable region (HCVR) comprising an amino acid sequence selected from the group consisting of SEQ ID NOs: 1730, 1762, 1778, 1786, and 1866, and a light chain variable region (LCVR) comprising the amino acid sequence of SEQ ID NO: 26; and wherein the second antigen-binding domain comprises a heavy chain variable region (HCVR) comprising the amino acid sequence of SEQ ID NO:18, and a light chain variable region (LCVR) comprising the amino acid sequence of SEQ ID NO: 26.

31. A pharmaceutical composition comprising the bispecific antigen-binding molecule of claim 1 and a pharmaceutically acceptable carrier or diluent.

32. A pharmaceutical composition comprising the bispecific antibody of claim 2, and a pharmaceutically acceptable carrier or diluent.

33. A pharmaceutical composition comprising the bispecific antibody of claim 3, and a pharmaceutically acceptable carrier or diluent.

34. A pharmaceutical composition comprising the bispecific antigen-binding molecule of claim 30, and a pharmaceutically acceptable carrier or diluent.

35. The bispecific antigen-binding molecule of claim 30, wherein the first antigen-binding domain comprises a HCVR comprising the amino acid sequence of SEQ ID NO: 1730 and a LCVR comprising the amino acid sequence of SEQ ID NO: 26, and wherein the bispecific antigen-binding molecule is a bispecific antibody.

36. The bispecific antigen-binding molecule of claim 30, wherein the first antigen-binding domain comprises a HCVR comprising the amino acid sequence of SEQ ID NO: 1762 and a LCVR comprising the amino acid sequence of SEQ ID NO: 26, and wherein the bispecific antigen-binding molecule is a bispecific antibody.

37. The bispecific antigen-binding molecule of claim 30, wherein the first antigen-binding domain comprises a HCVR comprising the amino acid sequence of SEQ ID NO: 1778 and a LCVR comprising the amino acid sequence of SEQ ID NO: 26, and wherein the bispecific antigen-binding molecule is a bispecific antibody.

38. The bispecific antigen-binding molecule of claim 30, wherein the first antigen-binding domain comprises a HCVR comprising the amino acid sequence of SEQ ID NO: 1786 and a LCVR comprising the amino acid sequence of SEQ ID NO: 26, and wherein the bispecific antigen-binding molecule is a bispecific antibody.

39. The bispecific antigen-binding molecule of claim 30, wherein the first antigen-binding domain comprises a HCVR comprising the amino acid sequence of SEQ ID NO: 1866 and a LCVR comprising the amino acid sequence of SEQ ID NO: 26, and wherein the bispecific antigen-binding molecule is a bispecific antibody.

40. A pharmaceutical composition comprising the bispecific antigen-binding molecule of claim 35, and a pharmaceutically acceptable carrier or diluent.

41. A pharmaceutical composition comprising the bispecific antigen-binding molecule of claim 36, and a pharmaceutically acceptable carrier or diluent.

42. A pharmaceutical composition comprising the bispecific antigen-binding molecule of claim 37, and a pharmaceutically acceptable carrier or diluent.

43. A pharmaceutical composition comprising the bispecific antigen-binding molecule of claim 38, and a pharmaceutically acceptable carrier or diluent.

44. A pharmaceutical composition comprising the bispecific antigen-binding molecule of claim 39, and a pharmaceutically acceptable carrier or diluent.

45. The bispecific antigen-binding molecule of claim 24, wherein A1-HCDR1, A1-HCDR2 and A1-HCDR3 comprise the amino acid sequences, respectively, selected from the group consisting of SEQ ID NOs: 1732-1734-1736, 1764-1766-1768, 1780-1782-1784, 1788-1790-1792, and 1868-1870-1872.

46. A bispecific antibody comprising a first antigen-binding domain that specifically binds human CD3 and a second antigen-binding domain that specifically binds human MUC16, wherein the first antigen-binding domain comprises three heavy chain complementarity determining regions (A1-HCDR1, A1-HCDR2 and A1-HCDR3) and three light chain complementarity determining regions (A1-LCDR1, A1-LCDR2 and A1-LCDR3), and the second antigen-binding domain comprises three heavy chain complementarity determining regions (A2-HCDR1, A2-HCDR2 and A2-HCDR3) and three light chain complementarity determining regions (A2-LCDR1, A2-LCDR2 and A2-LCDR3);
- wherein A1-HCDR1, A1-HCDR2 and A1-HCDR3 comprise the amino acid sequences, respectively, of SEQ ID NOs: 1732-1734-1736, and A1-LCDR1, A1-LCDR2 and A1-LCDR3 comprise the amino acid sequences, respectively, of SEQ ID NOs: 28-30-32; and
- wherein A2-HCDR1, A2-HCDR2 and A2-HCDR3 comprise the amino acid sequences, respectively, of SEQ ID NO: 20-22-24, and A2-LCDR1, A2-LCDR2 and A2-LCDR3 comprise the amino acid sequences, respectively, of SEQ ID NO: 28-30-32.

47. A bispecific antibody comprising a first antigen-binding domain that specifically binds human CD3 and a second antigen-binding domain that specifically binds human MUC16, wherein the first antigen-binding domain comprises three heavy chain complementarity determining regions (A1-HCDR1, A1-HCDR2 and A1-HCDR3) and three light chain complementarity determining regions (A1-LCDR1, A1-LCDR2 and A1-LCDR3), and the second antigen-binding domain comprises three heavy chain complementarity determining regions (A2-HCDR1, A2-HCDR2 and A2-HCDR3) and three light chain complementarity determining regions (A2-LCDR1, A2-LCDR2 and A2-LCDR3);
- wherein A1-HCDR1, A1-HCDR2 and A1-HCDR3 comprise the amino acid sequences, respectively, of SEQ ID NOs: 1868-1870-1872, and A1-LCDR1, A1-LCDR2 and A1-LCDR3 comprise the amino acid sequences, respectively, of SEQ ID NOs: 28-30-32; and
- wherein A2-HCDR1, A2-HCDR2 and A2-HCDR3 comprise the amino acid sequences, respectively, of SEQ ID NO: 20-22-24, and A2-LCDR1, A2-LCDR2 and A2-LCDR3 comprise the amino acid sequences, respectively, of SEQ ID NO: 28-30-32.

48. A pharmaceutical composition comprising the bispecific antibody of claim 46, and a pharmaceutically acceptable carrier or diluent.

49. A pharmaceutical composition comprising the bispecific antibody of claim 47, and a pharmaceutically acceptable carrier or diluent.

* * * * *